United States Patent 7,745,391 (HUMAN THROMBOSPONDIN POLYPEPTIDE) - sequence listing, part 22

SEQ ID NO: 54063 - DNA, 701 bp, Homo sapiens
cttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctaaaaaaaa

SEQ ID NO: 54064 - DNA, 208 bp, Homo sapiens
taaataaaaagaaatggattaaaggttcagcagatgggcaaaagttctagagtagataaaatgtgggttagatttataaaaacacttcctgggactgactactatttgagattataatcagttcctgaagaagaatactggatatctttttaaaacaaaaagagataacagtaatcctttatcaactgagtgcttcctttgtaccaag

SEQ ID NO: 54065 - DNA, 481 bp, Homo sapiens
tgaatgcctggtttgaattataagattatctcttagaccagtcactgtggccacagatagtccagcccagcggggtcactgtccacctgtttgacgttgtgtttgtgggttagagaggaaagcaggagggatgggttaggtgtggtagaagaactacagggaaaattttcagcttgatataagaaaataatttctgccagtactgtctaaggcagcctcttgaggtactaggctccctaccaatgcacacatttttggaaagaggatagaactgttccatgatgctattgaagggttcagatactacatggatggtttagctaattgccgtttaatatcccttttcagcctgtgagtctgtgagcctacaaaattctatcatgtaacttcgtttatgttaatggcaataatcgctcatttgtattgtactttacatcttgcaataaaaacatgttaacaatagaaaatgaatatacaaaaa

SEQ ID NO: 54066 - DNA, 377 bp, Homo sapiens
atttaaattctcttatttctttattcataagcgttgtttgccacttaatgatattcccctttgttttttcctggctgaactcatttccaaagagtttgagagctggggaaaggataaaagtaaggggacatcatagacatccccacacattgttgcagtggtgctgtagtctgattgtgatcccccgaaattcatatgcttatgacttaacctcaaaggtgatggtagtaatagctggggcctttgggaggtagttaagtcagtcatgacagtggccccttcatgaatgggattagtaccttataaaagagaccccagagagctaacttgctccttccaccatatgaggacacatggagaagttgctgtctatgaat

SEQ ID NO: 54067 - DNA, 365 bp, Homo sapiens
tggagggtggttcctgctcaatcagctcttggagtgcattacatttgtttcctgcagcaggtgtgtgtcctcgcagactggggccatcgacccagtgtccggggatgcccttctgactcctagagggccggactgtcaccaagcatgtgtcacctacccggcccacgccaagggcaacatactggactgagcagtgtgggtgcgtgaacactggcgcagggtttgcccctgagcctgggctggaggcctgggaccctggaccccaagttgccttccaggagcgacaatgacacttcaaagggtgggctgggggcagtcggggggcaaagtctagtggagggggtgacttcagtcaccaggagctg

SEQ ID NO: 54068 - DNA, 330 bp, Homo sapiens
gcaaatttacaaataaatacaaatccatatacaaaaaccacaacaaaaccataaagggacaagtaaagaaagaaagataatgtggtgtaagaagacagagggccaagacaaagcagagatgcccactggggctaaaattttctcagcctcaggctcaggtgacagtgagggataaaatactaaccttgagccacacaaatctgaatgaaaaggcagatcatggaggtttgaggcacggacattcttgccctgaagtttcagagcatcacaaattttcctagtttccttttcatagaatattattctgacttggttcccttatcatacatt

SEQ ID NO: 54069 - DNA, 547 bp, Homo sapiens
atatttgtgaaaaattggataaaggatgaggaacaggggcaatttagaagattgtttagtatctatattcttatttaacagcagccttcagagctaaagaagcccaaaggcctcttaacacctaatcacccatttattcctcttaaactctcacctgcaatcaaaacctattcagaaaaccagaattttaatgtaaagatctcagtatgaaggtttttggtattttatgatctaaacaaaccttccaaagtctggtgaggctcaagttggcaaaccacctgcaatcttcccactaaactatatttagtatcccactgtagcacccactgcaactgacatatgaatacactgtgctaacaaatacattacttaatacaaaactcttcaatttattacattgtgtcataaatttgttttgctttataagaaaatagattttaactcaaaaagtttcttatttggaacaaatgcatgaagcaaaggttttcaagcactggacatcaagcaaccaacaacttaattcccaggaaatgaaaaactgatgagg

SEQ ID NO: 54070 - DNA, 1551 bp, Homo sapiens
agaagggagggtagtggggacagtacctcacttgtctgctcgatgtcagcagtggctggagaatctctcgccaggtgccatcttgccaatctcttctccctctgccctctgtgggtcttttgttgagggctgggctgtacatgcatagtatgagattctgtgaggcctagaaaagagcagctgctatggggttgaaagaagaatggagaaggccgggtgcagtggctcatgcctgtaatcccagcattttgggaggccgaggtgggtggatcagttgaagtcaggagtttgagaccagcctggccaacatggtgaaaccccatctctactgaaaatacagaaattagctgggtatggtggcacatgcctgtagtacaagctacttgagaggctgaggcaggagaatggtttgaacctgggaggtagaggttgcagtgagccaacattgcgttattgcactccagcctgggtgacagagcaagactctgtctcaaaaaaaaaaaaaaaaaaaaaaaaagaatggagatactagaggttgcacagtgctgagaaatatgaggttctgacctagccagagtggagagaactttttaacatcataggcattcaattgaaaaaccacaccttaggggaaagaaccacctcctagagtaaagactactctaggcagggtgtggtggctcacacctgtaatcccagaactttgggaggccaaggtgggcgaatcacgaggtcaggagtttgagactggcctggccaatatggtgaaaccccgtctctaccaaaaatataaaaattagctgggtgtggtggcaggtgcctgtagtcccagctactcaggaggctgaggtgggagaatggcttgaacctgggaggcggaggttgcagtgagccgagatcacgccactgcactccagcctgggtgacagagtgagactccatctcaagaaaaaaaagaaaaaaaagatgagaagagaacagatggaaaattagagaaggggaggccaatgaaaggtagagaaaggaaagaaagggaagaggtgcacagaaaaaaaaaggtggggctgggcgtggtggctcccacctgtaatcccagcactttgggaggccgaggtgggcggatcatgaggtcaggagatcgagaccatcctggctaacatggtgaaaccccgtctctacgaaaaatacaaaaaaattagccgggtgtggtggtgggcacctgtagtcccagctactagggaggctgaggcaggagaatggcgtgaacctgggaggcagagcatgcagtgagctgagatcacgccactgaatagagccccagagacctgtgggacaataacaaaagaagtaaataacacatatcgcaagagttacagaataagaagtgagagaaaatgtggggttgaaaatatattggatgaagtaaggctgaaattttcctaaattttgtgaaaggtataaacttacagattcaagaagttgcgaatgaatgccaaagaggataaactcaaagaaatacatgctaagatactttttttttcttttttttag

SEQ ID NO: 54071 - DNA, 505 bp, Homo sapiens
aataaataaaaccatttttattccaccacaaaaatgagcatgaaaaagattttaaaaattgaactgtaacacacagaaaagtaaacaaagcaacttccatttctggaaatgctgggattacaggcatgagccaccgtgcctgacctgctaagacacatcttaatgaaacttttgaaaactaaaaggaaaagtcttgaaagtggctacagagaaatgatgtgttgtatataggggaacaccaatttgaatggcagcaaatttttcacctgaaacaatggaggtcagaaggcagtggcacaatatttttcaagttatctcaagaagataactatcaattacaaattctatctctggtgacgatatccttgaggaatgaaggagaaataaagacatttttacacaaagaaaacagagaatttgatgctagcagacctactctcaaagaatggctgatggaagttctccaaacaaaggaaattataacagaagacatggaacttcaaaa

SEQ ID NO: 54072 - DNA, 543 bp, Homo sapiens
agaagggagggtagtggggacagtacctcacttgtctgctcgatgtcagcagtggctggagaatctctcgccaggtgccatcttgccaatctcttctccctctgccctctgtgggtcttttgttgagggctgggctgtacatgcatatgctgggattacaggcatgagccaccgtgcctgacctgctaagacacatcttaatgaaacttttgaaaactaaaaggaaaagtcttgaaagtggctacagagaaatgatgtgttgtatataggggaacaccaatttgaatggcagcaaatttttcacctgaaacaatggaggtcagaaggcagtggcacaatatttttcaagttatctcaagaagataactatcaattacaaattctatctctggtgacgatatccttgaggaatgaaggagaaataaagacatttttacacaaagaaaacagagaatttgatgctagcagacctactctcaaagaatggctgatggaagttctccaaacaaaggaaattataacagaagacatggaacttcaaaa

SEQ ID NO: 54073 - DNA, 216 bp, Homo sapiens
aataaataaaaccatttttattccaccacaaaaatgagcatgaaaaagattttaaaaattgaactgtaacacacagaaaagtaaacaaagcaacttccatttctggaaatgatgggataatcgatactgcacctactctctccccataaacaactgtaaaactaaccaacatataatgaggcaactattttgagacattgcacaataagtactcta

SEQ ID NO: 54074 - DNA, 366 bp, Homo sapiens
atttcaccttgttagccagggtggtctcgatctcctgacatcgtgatctgcccaccttgacctcccaaagtgctgggattacaggtgcgagccaccgcgcccatcctgtattgttaatagagaccgggtttcaccatgttggccaggccggtttagaactgttgacttcaagtgatccacctgcctcagcctcccaaagtgctaggattacaggtgtgagccaccgcacccggcctcaggtgatgcttcttaaagagagcgtcctggggtgtgaggtctgcttgttggagaggttggtgctgagtcacccgcctccccagaactgcccagggtgggagcctctcagagtcgaaggtctctgcttct

SEQ ID NO: 54075 - DNA, 245 bp, Homo sapiens
gacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacct

SEQ ID NO: 54076 - DNA, 380 bp, Homo sapiens
gccaccttaagcaagttacttctctttagctgattattaaatagaataacatatggtaaatgtgtgccgtatagaagaaataataatgttagctgttccactagcaccactaagtcagcatgtcttaaaaatacatccactatctttcacccatgcactctttcagggctttttactttggctgggaatttgagagtcatccttggtactttcttctttctcacctcccacatccagatggttttaaggtccagccaattttttgatacaatgttatttatattcattcatatctgtccaaacctataatctactacactagttgaaatcctcattttctctcccctaaatcattgcatttagtttttaattggccttcc

SEQ ID NO: 54077 - DNA, 361 bp, Homo sapiens
cttcacaatctggccagtcagcatgggtgaaccttgaggacattatggtaagggaataaggcagttcccaaaggaccaacactgtgattccacttatctcaagtacctcagggagtcagattcctagagacagagagtggaatgtggatgccaggggctctggggaggggaaaatggggggttactgctcaatgggtacaaagtttcagttctgcaagatgaaatgagctctggagatggatgggggtgatgggtgcacgacaatgtgaatgtatgtaataccactcagtgtacactccaaaacgctgaagatgcttttatgttgtatgcatttttataataaataaattatacaataaag

SEQ ID NO: 54078 - DNA, 281 bp, Homo sapiens
gagggcgggacgtcactggctctgtccccgtcacccatgacctgcacgtcctggcagtggtgagcgcccagtgtgtgctgtgggacagaattatctctaaacccccgaaagaggatcctctccccaacttaactccagcctcggagggcctcgggggtctatggcacactctccctgctggctttgttctggaaagggctggcgggacatgaccggccccacgttgcactctgagggcagctcgggggtctgcaggggaccatcctgtgtaacctgctgac

SEQ ID NO: 54079 - DNA, 244 bp, Homo sapiens
gacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatccc

SEQ ID NO: 54080 - DNA, 370 bp, Homo sapiens
gcaattccaagatatccattgtaattactctggatttaaatagaactggtctcgtagcacaagaattcctgatagcaagatacttttcataagataccttcaacccggttaattttttttctgtatctgataaggtaaagtttagttcaagagtacagaacacatttatttacttttttgtctttctgaaagtacaaaggaccacccttatcaatctgtctttcccagctacttggaactctagtgacttttctctttgtgttttatagaaatagtttgtttttatgattcatttttgaaatgtgatttgtaggtatgcagaggagtaaattgtgaaaatttttaaggtattctgaagagacactttaac

SEQ ID NO: 54081 - DNA, 238 bp, Homo sapiens
aggaaaaggattgatcacaggagaggtaccaagggagttcccagaataatagaaaagaggatcctcaagaagacagtcacgcaagagaccaagagaagagctaatccaattgatgcaggaggaagtagagcttcagaaagaatgtctcaaaaaagaaaaaaaaagaaaggagtgggttaagtatctgatgaatttaccaaattgagaggagttacatagctctattgaaaatcttaga

SEQ ID NO: 54082 - DNA, 366 bp, Homo sapiens
tcttataagtcacttgaaaatggctttgcttaccagaaaagtttgcatatgtatatgcgtggtttgtataaatgtggagtttctggttgaacttgctctgaactcatgacttacttaaatagccttttactactccattgatctcacctatttgattcctctagtaccaactcagtaggaaaatctcaccagcaaatcttaaaaggaagcccttgatctttgccatctcaaacatcttcatttagctgacatgtgcctctgttctttccaaaagtttcctgttcacagttaaccaaagtcaaagaactaaacttcacaaaaagcaaatgcaatgtctaccaaaaagattcaaaagagttgaaatct

SEQ ID NO: 54083 - DNA, 1415 bp, Homo sapiens
agcgggggaagggcggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaagtgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaatgt

SEQ ID NO: 54084 - DNA, 1222 bp, Homo sapiens
agcgggggaagggcggcggttgctgacggggccgcctggacgacggttgacggaggtctagtgggacaatgtcatattataaatttggaatgctgaatagaaaattatagattttgatattgaaggaaatgaagcgaagcctaagtgaaaattcagctcgaagtacagcagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaatgt

SEQ ID NO: 54085 - DNA, 1351 bp, Homo sapiens
agcgggggaagggcggcggttgctgacggggccgcctggacgacggttgacggaggtctagtgggacaatgtcatattataaatttggaatgctgaatagaaaattatagattttgatattgaaggaaatgaagcgaagcctaagtgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaatgt

SEQ ID NO: 54086 - DNA, 1373 bp, Homo sapiens
agcgggggaagggcggcggttgctgacggggccgcctggacgacggttgacggaggcgagggaaactgagggcgaaagtctagtgggacaatgtcatattataaatttggaatgctgaatagaaaattatagattttgatattgaaggaaatgaagcgaagcctaagtgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaatgt

SEQ ID NO: 54087 - DNA, 1514 bp, Homo sapiens
agcgggggaagggcggcggttgctgacggggccgcctggacgacggttgacggaggcgagggaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtctagtgggacaatgtcatattataaatttggaatgctgaatagaaaattatagattttgatattgaaggaaatgaagcgaagcctaagtgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaatgt

SEQ ID NO: 54088 - DNA, 764 bp, Homo sapiens
attggcttcccgcaagctgcctgttttaacactccttgtgatttatttcaatctcatcttttacaaaggtacggcaatttgttccattttcctgcttccttctcctcttcctccttcttctaagatggcagagagaaactttcttacaggtcccagcaacactgccgtatagcttagaagactggagatatttattctcaatgtcctcagtttactttgcaactggagcattatttgaaagacggcctgccagcattcaactgaacagacacaaatgcaggtatgaatagtgaggggagagagtggtttgaaggctggggttgctgtcaggtctgatgaaccctccagcactcgccatcatcggctacaatgttgaggagactccatcacaacctcagatcaaaagtgtttctttgttcctccaaaccttccaaagcactttatggaccttgtatttggacaacacctccatgaagcttggaagccaataagtcacatcttcattgaacaattcatgaaattacagggcagacgtgaaatatgaccttcgagggaaaagctggcggtggagcccagaacttcattttgctgggatggttccctgccgttattctcctttctcacgaaaggatcctgcagtcaatttacggcatttgtaaataaaggcggctgtgtcagcctcctgcctggagaaaggaaggcagcaccttgaatgctgagagtgtatctcaggcttactctatacttccattacaatatctcag

SEQ ID NO: 54089 - DNA, 3338 bp, Homo sapiens
tagtccaggaattggtacacacagcgatagtgttcaatagcaactaggggattttggtttaggctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtcatcagacaatgtat

SEQ ID NO: 54090 - DNA, 3775 bp, Homo sapiens
tagtccaggaattggtacacacagcgatagtgttcaatagcaactaggggattttggtttaggctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagcagttgccagcctactgtgtacaggcactagagccccatgctgagcaggttgagcacacagtgctgctgcttggagtatctgcgtggatatgcctgagaagcatgggtctgatggttattctgggacataaaggagacagaccagaggcaaagaggccagtgaggactgctctgtgcagttgtccaggcctgaagaaggtggcggtgatttgaatcagaagaggtggcattctcttcattaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtcatcagacaatgtat

SEQ ID NO: 54091 - DNA, 1139 bp, Homo sapiens
tagtccaggaattggtacacacagcgatagtgttcaatagcaactaggggattttggtttaggctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtcatcagacaatgtat

SEQ ID NO: 54092 - DNA, 1135 bp, Homo sapiens
attatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaaacaaacaattaaaattgggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctccaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccac

SEQ ID NO: 54093 - DNA, 815 bp, Homo sapiens
ataattattaatcacttaattaaagtactttgtcaaatatattaattaattgaatacttgctgttttagtcaaaacagtgttctaaatactgtgagtaaaagaagagtgagtcataaaattttgcgctgacatttacaaattgatagaaatattatcatttattttaaaatacatatgtaaaatcacataaagataaatttgtattcaattaaaaagaaaaataaaatagtcacaatttcagagtctaagtctccaaataaaggaagtctggcaattgttacatgaaatttggaccaaattaaagatggccactctaattcctttatgttgcgtctaatgtggaaaatgatgtgcttgtatgcttcagaaaagacccgataaaccccattgtcaaatggaaacttgagaaaactaagtgtggtagaccaaattatggacccaaagatgtccatgccctaatccctggtacttatgaatatggttgttaaacaaaaagaggaattttgcaaatgtaattgaagatatggacctttaaatatggagataatcctagattatccattcagatcagcctaaatctaatcacataagccctgagagacagagaactttctcagtctggtggcctcaggcatgagccagaaagtcaagtcagcgattccacgtgtgaggattttacacactgttgctgaatctgaaatagaggaaaccatgtgcaagaacttgagagaggtttctagaaactaagagaagccaccagctaacagacagaaaggaagcagtaatttccgttatatagcttcaaaaaaaaaaa

SEQ ID NO: 54094 - DNA, 1166 bp, Homo sapiens
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaaacagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccagtgagtttggagatttttctcttgtttctttaaagactgctgggtatgtgaagtagttgatcaggttttcctggtataaggattagaaactaatataaagcctgtcattaatcaggggctcaatttgacctaattgaattggagaccacttgaggacaccattagaaaggccttccgagtctgagtaataattaatgacagagttttaaaatgtattttgcttttaaataaaatcaagtaaactgcaa

SEQ ID NO: 54095 - DNA, 2405 bp, Homo sapiens
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaaacagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgta

SEQ ID NO: 54096 - DNA, 1824 bp, Homo sapiens
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaaacagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaaga

SEQ ID NO: 54097 - DNA, 1995 bp, Homo sapiens
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaaacagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggttggttccagcggccacattaacctcactcatttcacaaatgactctttcaaaaccacacatgcattagcagaactctatcatgctgagttgttaaaggggagagttaattcatagtttatccattaaagttagatttccatttattattctgccttctccctttttaaagacctactttgggtgctgaaagtattggataagaaataatatataataaacctcacatacatgggaaatataagaattttcctagccagctgaaatttctttgttatcttggtagtgatttatagatgttaactgctatccttgtatttagtttcatgttggccttctcttgtgtattttttcttccttccttttgttgtactattataaattgaatgactaaggagacactgagttctacgtgcttacagcaaggtaattcagctgttcacccctacaccattgatttagcctgggatcgcatctgtttaaaaaaagattttttttaatgttcttgttaacacgcctaatatcatttgcttaaagaactgtaacaaatttctggaagaatgt

SEQ ID NO: 54098 - DNA, 2472 bp, Homo sapiens
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaaacagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgtataaggcttttttatttttcactgttacggtcaaaagcatactgagaaatgaggcagaaaatactccc

SEQ ID NO: 54099 - DNA, 1346 bp, Homo sapiens
gatccacgattacgtggagaagggtactcaagggaaaattgtggatgtggtcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgta

SEQ ID NO: 54100 - DNA, 442 bp, Homo sapiens
ggtacttcaattggaattgtcatgaggcagagttttaactggagaaattgaatgggtttcaaatgaaacttagtctttcctattgtttttaaggtctccccaaaccccttcgaagtgacagccgtaatgcaaagggattgctatgggcgatctcatttgtttcccggtatccccgagaggtgggtactgtgattgctctaactccgtcagagcgcaggcttatagaaggcactgtctccgagctgcgcccctctccccgccattctattaattcccaatgaagaaacgtaaggtgttgtgtatttcagcttcaactgaaggaggctggttaaaaaaggcaggaatcttcagggcccactcctatctggatttgagttaggaatttggcatttttaaataggacttgtgtggcacttggacgatttgagaagccctagtccgg

SEQ ID NO: 54101 - DNA, 208 bp, Homo sapiens
ctgctctaacacgtgaccacagtctagacgcacaatggaccaagtggaaggcaaagcacaagagattatatgacatgaatgaagaaggatggaggagagcagtgtgagagaacatgaagatgactgagcagacaatcaggaatacagccaagggaaacacagcttcacaatggccatgaacacctttggagacatgaccactgaagaa

SEQ ID NO: 54102 - DNA, 903 bp, Homo sapiens
agaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaa

SEQ ID NO: 54103 - DNA, 716 bp, Homo sapiens
gaatggcatgaacccaggaggcggagcttgcagtgagccgagattgcgccactgcactccatcctgggcaatggagcaagactccatctccaaaaaaaaaaaaaaaaaaatcccacaaagaaaagctcaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaaaa

SEQ ID NO: 54104 - DNA, 368 bp, Homo sapiens
cacttttttcagttttgactctttcaaacaatgcagccatttaaaaatattgtaaattttatcctctacacaaatacatgattttttttctgtgtgtatatatatacatacagggtggacatacatatatatgtagagactacatatatagctttctttttgtgtgttgtttaataaatccttactatgtgttcattaacatttggtcttattttaatgtgtatattatattagggttctttagaggggcaaaactaataggacagatgtatatatgaaagggaatttattaaggagtattcattcacatgatcacaaagtgaagtcccacaataagctgtctgcaagttgtgaagcaagaaagccag

SEQ ID NO: 54105 - DNA, 223 bp, Homo sapiens
cactggttacctaaagtcaggggtgtgtgtgtgtgtgtgtgtgtgtgtgtgtctgtgtgtgtgtacacgtatgtttacagaaaactgaggaaaaaggaaaaagggaaatggtgagattgtgtatttctcttctacaaatacttaatgccagcaagataacgcaattttatgtataagaataaggacaaacaaaaaacccgtgggtatttcatgaaagttaagg

SEQ ID NO: 54106 - DNA, 430 bp, Homo sapiens
ttggttccaggactcccaacagataccaatatctatggatgctcaagtccctgatatgaaatggcatagtatttgcatataacctaagcacatcctcccacatattttaaatcatctcaagattacttataatacctaatacaaggtaatagctctgtaacagttgttgtactgtattgttaagggaataatggcaaggaaaaaacatctgaacatgttcagtaatgatgctcttttcccaacccaatattcttgatctgtggttggttgaatccccagatgaggaacccacagatacagatggtcaactgtactattagtatggttcaaataaatttaaatcatgctttcaacatatgaaatttgttattctgtgacactctggtaatgtatcttctctttgtccccaaggttctgctaaaccagcaac

SEQ ID NO: 54107 - DNA, 408 bp, Homo sapiens
ttttgctcacagctacatcttcagaggtgagaaccatgcatgacacagagaagatgctcactgatggatttaatgagtcaaacattgaagaatcaatgagtgccggaaataaacaggataggtggcagcatagcatgcccttgagaacatggctgtggattcaaatcccagaccaatcactgaatttcaagccactttgcctctctgagcctctgttttctcatctgtcaagtggcaataacaataaatggtacgtgcctcataggggcaccttgaggattaaaagagagggtttcaataaatcaagtactgatttcaaaacctggcacatagtaggcactcagcacatggcccttatatacttatggccagcagcggctgggcctcatccctccctggctggctcca

SEQ ID NO: 54108 - DNA, 327 bp, Homo sapiens
caaagttttaacaataatggtggagtaattgatgtttctggagctgaaaccccaaaggtgttaggttacttgtaacagaaaaagtcttacaaatagttgttttggaaaaggggacagtatatataattcagaaagcattgttaacctgtgcaaactgtaattataacttagtgtcacaattttcttgccctcttccccttgcactcagatcttatcttgtagtaatgatatttattaactctttccacctaaactgcattgcttgactgtaatgctatgaacacactaggtgtcagatataagctgagtgtatcttcagaaaccaag

SEQ ID NO: 54109 - DNA, 417 bp, Homo sapiens
tactgggatgggcactgcttggagtggcagagatttcattcctccactttctggtcaattcttattttaaccttattcccaatttagaattttcatattttatcatctgagattaaatcgttctagaaggtaagcaattctttgtaggccaaaaacttcccacctccctcaacctacctagagaattttaaatgcattttccaaagatgttgggtaggtttttatacatggcaagaccctgatctctacaaaaaaatttttaaaaattagccaggtatggtggcgcacacctgtggtcccagcaactctgaaggctgaggcaggagttttgcttgagcccaggaggttgaggccacagagagctatgttcacaccactgcattccagtctggttgacagagtaaaactctgtctcaa

SEQ ID NO: 54110 - DNA, 500 bp, Homo sapiens
ttgttgtccagatcacagatggtaagacttaggcttctggggagcgacaaaccccacctaatcttgaacccaaacttcataatccatcccagtgtgccagaaagttgttcattacaactgatcagaagcagatgataaaaagtggcctcttacgtaagacttgcttttgttccttaaggttctcactccttcatgaacttcaaaaagagactgagttggcaaggctaagagggtagtagagcattcctgggtcctgtgatcatcaactcattactgttgtaaagcctctctgacatttattactgctttatttatgtcatgctacatgtggacatttcccccctagtgatacacagagatctacctcagcgttttaaaccatgactgtagtgaacactgtgatgtgccctccaggtaccccattcaggggaagatttattgccccatgactgggagtgctgtctgcagacagccccaagctgctagccatgcaggatgtg

SEQ ID NO: 54111 - DNA, 164 bp, Homo sapiens
tacaggcatgtgctctgggtccagtgtatttgctggtttacttatgaaaagtaagaacatgtgatatatatggcatgtgatttttttcacctatctatattgtgtacattcttctatgtcaatcttttttgtagttgtaataaatcagtaagttgtaattcatt

SEQ ID NO: 54112 - DNA, 169 bp, Homo sapiens
  misc_feature (3)..(3): n is a, c, g, or t
tgnaaaagatttcacaggccattgaaacatgggcaagacccagtgcctagagtctgcaagattggtcctaaagacatccaccacgtgtattgcgagtggaaaatagaaattcatgtttgactcaagctttagagattttgtaattctgtgagcatttaaaaatatttcc

SEQ ID NO: 54113 - DNA, 450 bp, Homo sapiens
gcagatttgtgtaggggatggagaagaacgtattatcatcaagtaaacaaaggcatggagctgtgaaggtgagggtttctctagacacctcacaatgagtccagagttcaagcaggaaaatggtacgtggtaggcagttaggtaagaaaaataagttgaatcccaaaataaagggccatgaggagtaggcaaagggttttggactttgcatcctgcctcctcctcctagactggtgacttacttcctgactagaatatgagatttctgaggacatgcccagcatcatgttctgcacgtaatctgcaaacaacattccatttattggtgactaaacactccggccctggggtgaaactgcctgggttcaaatcctgccccattccttcctgactgtatggccttggataaggtagttaacttctgcacacctctgtttccttatctgttta

SEQ ID NO: 54114 - DNA, 403 bp, Homo sapiens
caattctcccaccttggcctcccaaagtgctgggattataggtgtgagccacacctgtattatttacaatggttctcctacatgccaggctttgtttggtatgtggaaataaaaactgtgatgaataaataataaaccaccttcaaataacattaggattagagctgggtgtggtggctcatgcctgtaatcccagcactgtgggaggctgtgggaggctgaggtgggccgatcacgaggtcaggagatagagaccaccctggccaacatggtgaaaccctgtctctactaaaaatacaaaaaattagctgggtgtggtggcgggcgcctgtagacccagctacttgagaggctgaggctgaagaatcgtttgaacccacgaggtggagggagactctgtctc

SEQ ID NO: 54115 - DNA, 327 bp, Homo sapiens
aagaagagaaatggggtagctatttttgagtgtcctgctgttgggagggggaagatgttttctctcttctgatagctgtagaccagtgggaaaggatttttcctactctcttttccctcattgagcactgtgtacccaagtgtatccttgcagagtagtttggtgatgtttgtttcagctcaacaggctcccaaaatccagttcagcctgcagaatttgttttgtcagtgccattacccggccacctgctgggtgcagaggcgtaaagcatttgttagctgggcacatattgtgtgttaggagtttttgcatctcttctcggcgtcg

SEQ ID NO: 54116 - DNA, 695 bp, Homo sapiens
taggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggagggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagt

SEQ ID NO: 54117 - DNA, 385 bp, Homo sapiens
gtcacaggtctcaattgcaagtagcatgcaagcaagtaggctgaactcttgtctgtcaatctagctccttcctggatggggtatttaatcagctctcccttccccaagcacccagtggacttgaagctcacagttagacagagatggcctagaggtgcccaagtgcctgtttatccataggtgacatcacctgtgtgctcagagttataaacataggcagcttgcctactgccaaatccattacaactttcagaggtgttcacttaggaagaggaggaaagagttttttgagaaccagatgggaacttagaaataagtaacattgacaaccaaatccttcagacacatcttcaagtttccaagagagtcagttaacaaaaaaaaa

SEQ ID NO: 54118 - DNA, 139 bp, Homo sapiens
  misc_feature (95)..(95): n is a, c, g, or t
gaccatatgatttgctgtccaagctgggacaccttcaagaataaaataaatatttaataagtttgtccagacaatgtatgtaaaacaggcccatntggaaaaaaacaagtatcttcatccttgctcaagttcacagatc

SEQ ID NO: 54119 - DNA, 1307 bp, Homo sapiens
agtgatggcttacacataatctagcacatttggagacgaggctggtggattgctttgagctcaggagttcgagaccagcctaggcaacatggtaaaacccagtctctactaaaaaaaaacacaaaaatttgcctggtgtggtggcatgtgcctgtagtactactcaggaggctgaggctggagaatcgcttgaacccagaaggcagaggttgcactgagctgagatcgcaccactgcactccagcctgggcaacagagtgagatcacacacacacaaaaagttaacacttctgtatgggaaaagacaagatacacatctaaaagacaagccaagactgggaaaaacaacgtaacacatataaccaaaagaggattcataagtagaatttataaagaactccaaagaatcaataacaaaaagatgacccaatttttaaaaaggacaattgatataaaaaagctatcgaatgggaaacacaaatacctaataatatatacatatgtgcatatacgtacatacacatatacatttaacctcactagtaatctaggaaagactaacaatattttgcactcatttatacactagaaaaattaatttaacaagatcaagtcttagcatggatgtgaaacaaacagaactcatgccgttgtggatatatgaaacagtacaatttggaaagcaatttggcaataactagtaaaaaataagggtgaagaagtatgtatcctataaacccgcaatcccattctgggtagatagtcactgaagcattatttgtatcacagacaatgtgaacacacttcatgggtaatgtctatcaacacaaggatgggcaaactggtataattcatataataaaatactataaagcagctgaaaattaatccttccagctgcaggttagtcctcccaccataaacaactgtagacatggacaaaatgtattgattaataaatttgttaaaaaaaaatctggcagtctgctgatccagactttggtttaactcatgctgtggtggatatataaaacagtacaacttggcaactactttcaggcagaggacaacaggaagcaaaagactgatccctaagtgtaaggaaacttgtgagatgagccccaaagtcacctagttcctctacctggggatcgtttcccaactgcagtgcagagagctggagtctgagcacagtagggagatcccgctgggctgaagaggcagagatgaggaggcagagatcaggctgagacagctgaaatggcagagaaatggggcagaaaaaagaaaggagggcactatgcaaa

SEQ ID NO: 54120 - DNA, 512 bp, Homo sapiens
ttcccctgggcctctctcggggtcttcagggcgtcgtgccttcagctatcctctatcggctgccctcctcctgctcttcaagagctgcttcttcctgctcctcctcctcgtactcttccacgacctcttctatgtagacatggacaaaatgtattgattaataaatttgttaaaaaaaaatctggcagtctgctgatccagactttggtttaactcatgctgtggtggatatataaaacagtacaacttggcaactactttcaggcagaggacaacaggaagcaaaagactgatccctaagtgtaaggaaacttgtgagatgagccccaaagtcacctagttcctctacctggggatcgtttcccaactgcagtgcagagagctggagtctgagcacagtagggagatcccgctgggctgaagaggcagagatgaggaggcagagatcaggctgagacagctgaaatggcagagaaatggggcagaaaaaagaaaggagggcactatgcaaa

SEQ ID NO: 54121 - DNA, 393 bp, Homo sapiens
catcaggccacctcaggtgatctgcctgcctcagcctcccaaagtgctgggattacaggtgtgagccaccgtgcccggccattggttctttgtttttattcacttattcaacaaatgtattttaggtgtcaggctctgctctaggccttggagatacattgctgctcagaaaagtctggatcttgcctactaataatctaaatctagcaagagagacaaacattaatcaaattctccccaaaatgaaagtaaaattacagacatgataaacattagaaagagaaaatatgtcacaggcaggcatgacctagaagggtgccaaggaagacattcctaaggaagtcaggctggagtcgaggcctgacacggaggaggaggggagggagcctctca

SEQ ID NO: 54122 - DNA, 449 bp, Homo sapiens
ttgagccccctctctggtctgcttaggcctctcctgcattttcaccaggtggacctgtcccgaggcccaagggatactgtttgttgggggcttaggtgaagcctggggcatccaaatgcctacacgcaggccccctggggcactgggcaaagccggaggtgggaagagacggaggtgggaagagccacaggcccaggccagctccttccttgctgccacttttggcaccacactccaaggagtctgataattccaaattggcccgggcattccatggagtccgggaggtgtatatgccaaggtaggaggggaatgtgattttgcttgttagtttcatggataccttctaaaccctttaaaacattgagacagatggcatgtgggcccacaggtgtgaggagcgggcctggctttgttctttctgttttcccgcagcctaggacagcgcc

SEQ ID NO: 54123 - DNA, 470 bp, Homo sapiens
agagagagtcaagctgatcaagtggtgggaggcaggatgtgtggacagacctggctgtagttagaacagccactcctgcctgtacaaccctgactttactgtgtttcacatgcaccttcacgcccgttgtcttacttactctttgcagttaccctttaaggaaggaagggcattcgttgttatgatgatgatttgagggccaggtaaactggggctcaggaggtgaaatgactggtctgctatcgcagtgctgatatggacagagccaggagcagccccacggactctcgttagagcttcctcacacttactgtgtagccttgggcggttgtgtccctgtcctgggcctcagtttccccattcatataacaaagggctgagatttgagtcagcttggccatgctgggtggggtacaccagagcctggagccagaattcctcctggaatccctcccctgtcttccagctct

SEQ ID NO: 54124 - DNA, 359 bp, Homo sapiens
atttttagtggagacggggtttcaccgtgttagccaggatggtctcgatctcctgacctcgtgatccacacgcctcggcctcccaaagtgctgggattacaggcgtgagccactgcgcctggcctaatattttcatttttggctcacaaatttcccccttttaaacttcccatagctgttccccagacctcacttcccctgtgcctctgccctgggccctggagctctggagaagcctctctgttctttgaagcctggactgtcatttgaagctctagactttccaggttgatgcctaggagcataggaggccatcatcaacccctggaaacatctctgggcgtaggctgccaggctgg

SEQ ID NO: 54125 - DNA, 239 bp, Homo sapiens
caacccgtatttgggatcatcctccatttcaaataatacattctctctgttcatccgagttctttgtgagggccaggccactctgcacatgggccatagtgagggtgagtgtgcaccctgttccagacacttgtttcctctttgaattctcaccaaacaaggcagaagtatcagcaaaaataaaccaaaaaatagtatatgcagtttcactgcacctcttcttctggggctgaagataa

SEQ ID NO: 54126 - DNA, 753 bp, Homo sapiens
gtgcatcagaatcttaacaatgaggggctaagacacaaattcctgccctcctccctgccgcccccctccagagtttcagattcataggtctcggttgggtctgagaatttgcattcccaagcaagttaacaggtgatgctgatgtttctcaggggataacgggcaaatggtgaaacccagaaagttttgtttctagatatgagatcccattgtctttgccaatgaagctgtgctgtaactccatcttaacaagtaaccccaaattatacccacctgaaagacctttgtgggttgtggaaaacctggaagatggctgagagacagtaccctcgaagtagttctgaggagattgttctgcttgtattcccatgcagcgccatcactgcctgacttccttatgtgtgtctgatttgaggcagttctctaggaaccagttcctggtgctgcagtgccactggcagcttcccagggcttccagaaccctagtggcatggtgggaactcctgttcctcacccgacctctccacagccctggacctgtaaggtttcttccaggctacatggaattagatttccacttttccttggtgaatggtgatgctgattatttggaagctttagcaccaaagtttgaaattcccctaagtgaatggttttggcgatccccttcctttagttatactattggctttctctcatgttcatttaggttgccaaatcttctgtataatcctcatcccccatcaaaagaga

SEQ ID NO: 54127 - DNA, 856 bp, Homo sapiens
gtgcatcagaatcttaacaatgaggggctaagacacaaattcctgccctcctccctgccgcccccctccagagtttcagattcataggtctcggttgggtctgagaatttgcattcccaagcaagttaacaggtgatgctgatgtttctcaggggataacgggcaaatggtgaaacccagaaagttttgtttctagatatgagatcccattgtctttgccaatgaagctgtgctgtaactccatcttaacaagtaaccccaaattatacccacctgaaagacctttgtgggttgtggaaaacctggaagatggctgagagacagtaccctcgaagtagttctgaggagattgttctgcttgtattcccatgcagcgccatcactgcctgacttccttatgtgtgtctgatttgaggcagttctctaggaaccagttcctggtgctgcagtgccactggcagcttcccagggcttccagaaccctagtggcatggtgggaactcctgttcctcacccgacctctccacagccctggacctgtaaggtttcttccaggctacatggaattagatttccacttttccttggttcacagggggcaggagccaggttggaacggctgccaaggagactgtcttttttcagagcccttaactggcagtcagcaagaccgaactcctctgctccttggtgaatggtgatgctgattatttggaagctttagcaccaaagtttgaaattcccctaagtgaatggttttggcgatccccttcctttagttatactattggctttctctcatgttcatttaggttgccaaatcttctgtataatcctcatcccccatcaaaagaga

SEQ ID NO: 54128 - DNA, 675 bp, Homo sapiens
tgaccaaggacaaggacacctacatggacactgtcaacagataccacctcacggagccggaaagaaacacatcctctaaactcaaggactgcgtgaccgacacaatgacccccgaggagacagaggccgtcgtgcagcaactggtgagtgcagcagggcccggccaccagcgccaccccacagcccttgacctcctttgagagcagggactctgttccctgagagcctctctctccacccaaatacctccccacctctcaccaagcaaccacctctcacacgggcagctgcccagggacaagacctcagggcgctggacctccgcgctctgatgctcagcctccgcaatcaaccccatcctatccctccttccccagaagacccctcccttcggcctcccacccctccccacaggaagaaatcaacaaccagtgtgccgacacgatactgaagtaacaccatccataggcacctcgggttcctgtccaggctgcctgtcccaaccatgagaatctgggcccagggccccaccctccctagctcccgccctgctgctgcctctactctctctcctgctgtgctgattggggcaagcctgggaacggctgccccccacctccccacccaggcctgtcccctgcgggacaatgctgcctaataaactcacctgcatcc

SEQ ID NO: 54129 - DNA, 222 bp, Homo sapiens
cagtagagaaatttggtgctggaaatatttactatagtgctggcacataaaccaagagctatcagactttaatgcttttttccctaaactttttataggctttcatttttaattgttgccaatctgctgattttattttaaatagatacttcaaggctgtgctttgtcaaaacagacagatgtatcattaaattccctcccaaattacacattaggcaatgt

SEQ ID NO: 54130 - DNA, 343 bp, Homo sapiens
caatcagaattaaagtcaaagttcttacaattattcccataatatacacctgaatgatagcctccaattcttacatcttaactactcacttcctcagcagtccactctttgaatatgtgagacatatttctctcaacatcttcctctagttctctccaaacctggttctccaacttccgtaagtctttactcaaatgatatcccctgagtgaaacattccctatctaaaaaaaataactctgtcctctttttttgaatacttcatatttccattccatgctacatgtttttttctccttgatactcatcagcatcctatacgctatgtattttatttattttc

SEQ ID NO: 54131 - DNA, 1509 bp, Homo sapiens
caagagggaggccgggccaggggctggtggcttcctccgcgagctctgccagtttctggcctcaggtcctgagttgttatcgcaagtccaggaagaatgaggttactcaggcaactggagggtgaggatggagaagagctttattgagcaacagaacagctctcagcagagaggagacccaaagtgggtagctcctacctgcaggaaggtttctgaagggggccaagatggcccaataggaacagctccagtctgcagctcccagaaagaccaacgcagaagatgatgaattagagcggttgttatcgaatctgccaccagagggcgatccaggctgaaggtgacattacacttagagggatccacagattcaagaggctgcttggggagggcagcacagtgaagtacaaggactttgacatcagagaggcctggattcaagtcccaatttctgtgtgtggtaaccagtctgcaagacagcctgtgatggttcctgcctcctcgtattcatgtccttcttagttcccttgcgcattgaatcagggctggctctgggtgaccaatagaatgtggaggaagtgatggggtgtgaattccgaggctaggtcacaaaaggcattgtatcttccacctcttagatctctctctctgcggaagccagccaccgctctccaaggactctcgagcagctccatctacagattcacatggagaagaattaagggttcctgccaatcaccagcaccactttgccagccttgtaagtgggccaccttggaattggagcctccagttcctactgacatctgactgcaacatcatgagagaccctgagtttgaaccacccagctgagctgcttctgagctaacccactgaaaccgtgaaagtacctgaatgaaacaacacccagtagccactagcacacctagctcccagatctgtttttgatgccattcttcagtaaaaggaagcaaggctgcttggagaaattgctatcaaggactggggtagaaaatatacaagatgaaattggagcatcttgtagtgcttgaaaacagttggcatctgtgtgaagatgtgaatggaggaggcagagtaggcagtgagtgccgcagccacagcttgtgttctctgcagccctggcacagaagataggaacactcatgggggatgcggccactgtgatgtcttcccacacaagaagtgccaagtgcttttctcatgcttttctggattgtcccatggtggacgagtcagcaggagtgagatggagcagcacagtagagggcacctgctctgttttgtcccaggccaggatatcgttgtacatattctcagctaagtgagcaccaatagaggagagggagagtctcatggaagttccttctaagcctttggctctttttaccttcaacaaggtgtgccacctctttgatccagcaagtgggaagaacagtcccggcctctttgcacacaagaccgtgataccaatgcaccatcacaggccc

SEQ ID NO: 54132 - DNA, 1313 bp, Homo sapiens
caagagggaggccgggccaggggctggtggcttcctccgcgagctctgccagtttctggcctcaggtcctgagttgttatcgcaagtccaggaagaatgaggttactcaggcaactggagggtgaggatggagaagagctttattgagcaacagaacagctctcagcagagaggagacccaaagtgggtagctcctacctgcaggaaggtttctgaagggggccaagatggcccaataggaacagctccagtctgcagctcccagaaagaccaacgcagaagatgatgaattagagcggttgttatcgaatctgccaccagagggcgatccaggctgaaggtgacattacacttagagggatccacagattcaagaggctgcttggggagggcagcacagtgaagtacaaggactttgacatcagagaggcctggattcaagtcccaatttctgtgtgtggtaaccagtctgcaagacagcctgtgatggttcctgcctcctcgtattcatgtccttcttagttcccttgcgcattgaatcagggctggctctgggtgaccaatagaatgtggaggaagtgatggggtgtgaattccgaggctaggtcacaaaaggcattgtatcttccacctcttagatctctctctctgcggaagccagccaccgctctccaaggactctcgagcagctccatctacagattcacatggagaagaattaagggttcctgccaatcaccagcaccactttgccagccttgtaagtgggccaccttggaattggagcctccagttcctactgacatctgactgcaacatcatgagagaccctgagtttgaaccacccagctgagctgcttctgagctaacccactgaaaccacagttggcatctgtgtgaagatgtgaatggaggaggcagagtaggcagtgagtgccgcagccacagcttgtgttctctgcagccctggcacagaagataggaacactcatgggggatgcggccactgtgatgtcttcccacacaagaagtgccaagtgcttttctcatgcttttctggattgtcccatggtggacgagtcagcaggagtgagatggagcagcacagtagaggggccaggatatcgttgtacatattctcagctaagtgagcaccaatagaggagagggagagtctcatggaagttccttctaagcctttggctctttttaccttcaacaaggtgtgccacctctttgatccagcaagtgggaagaacagtcccggcctctttgcacacaagaccgtgataccaatgcaccatcacaggccc

SEQ ID NO: 54133 - DNA, 564 bp, Homo sapiens
tggtcaggctagtctcgaactcccaacctcaggtgatccacccgccacggcctcccaagtgctgggattacaggcgtaagccaccacgcccagacaagaataaaattttaaagaaggggtagaaacacagtgcaatatcgtacttctctaatttatcacatctaaaatggggagactcattgagtttatatgatgaatttgccagatttgcagtgtatgtggccagcactgttttaaaagaattcatcttctatatagttaaatttttgttaaccataatacttccttctgttagaccacaaaattagccacagagtagcattaccttatagctattttcttgttctcaataaaagaaatgtgctgtttaataaaagttttttttaattatatggaatgataggattaaaccttacctagtagaaatattgtcatagatgaggcggtatgagtgggaaacactttgtaaataagtaagtgctggacaatcgtttcttattttacattgtgtaaagtctaggattaaaccatatgacagcagttttcaaactttttcttttcagg

SEQ ID NO: 54134 - DNA, 449 bp, Homo sapiens
tggctgtccaaggtcacacagcctgtgggtcctgggctgccaccagggggtctcccaacatccccattccgtcacccatctgtccttcatgcccgtgatggcagctttatcccaggtcccagcagaagccgcggctgcaggggcagttaggcaggcaggtaaataaggcatcctgggccgggcgcggtggctcacacctgtcatctcagcactttgggaggccgagaccggcggagttggagaccagcctggccaacatggtgaaaccccgtctctactaaaaatacaaaaattagctaggtgtggtggcaggcaccttataatcccagctactagggaagctgaggctggagaatcacttgaaccggggaggtggaggttgcagtgagccaagattgcgccattgcactccagcctggacaacagagcgagactctgcttcaaaagat

SEQ ID NO: 54135 - DNA, 270 bp, Homo sapiens
aaaactttttagttttagtgaagctgaatttatgttattttgttgcttatacttttgttatacctaagaaaccatggtctctccaaggtttttaatttactcgtatgttttcttgtaagggctttatagttttagctcttatatttggtttttggtctattttgagttaatttttgaatatggagcaaagtaaagcttttgaaaactaacagatgtgcaaaattatttttaatttttgaatatggagcaaagtaaaacttttgaaaacta

SEQ ID NO: 54136 - DNA, 373 bp, Homo sapiens
agataaacaacttcaagtgcattaatatgttgtggaaactgcaatgaaaaaataatggccttgcattgtcaaagcaaagacatgggaagcttagcaagtaaaacaataaaatgagcagagcgatattgaaacaggtgaagaaaagagcatgatgtgttgagttcagaaaaattattgatggcacagaaatggagagaaagactgatgagtgaatagagaagtagctcataagagattcaagctcacactgaggcataaagccaacctgactgcaaattttgtcaggttgcagctaggagagtgacaaggcagaatgtgttcagaagatggaaatttttatcaaaagctgttaattctagaaggaatattggag

SEQ ID NO: 54137 - DNA, 717 bp, Homo sapiens
tttttttgagatgcaattttaaatagggtggcttggacagccacctgagttgggtttaaaagctgccagctccagccgtccagctgtggggccacggtgccagacagtggtggtggttataggaccgtaggtgtttaccaaaactagacaagtccacataacaaccaactgcacaaataaggagtaaaataataaagagaaggacgtgtgaggcaggactggattgtagcccaggataaagagaagttgcgggatgacagctgtgccgtcggcccagacagaaccatctggacagaggacagaggataagggagatggttgaaaatactaccatcatatgataatgacaactaagccacaggaaaacaaggcagttttaacctcaggggaaatccctcagaaatggatggaatctaccagaagcatcatgagaggaagaggaagggaaacagagctaaattggggccaggtgtggtggctcgcacttgtcatcccagcacttttggaggcccaggcgggaagatcactggagcccaggagttcaggaccagcctgggcaacaaagcgagatcccctctctacaaaaaataaaaaactagccaggcatggtggtgcatgcctgtggtcccggttactcaggaggctgaggtgctggggaacaaggctgcagtgagctgtgattgtgccagcctgggtgacagagccagaccctgtatc

SEQ ID NO: 54138 - DNA, 341 bp, Homo sapiens
aaaagaactgtatgcttctcaggggaaatcctcaaaacaggatccagagacctaagctctgctaacagggctacagcagctgtatacatagctgcacgtgtccttgcagatgtgcagcaggacaagctcccaaggctgtacttgcatttacaagggaataccaggtgaggagcaatggactgcgaaacatgcgtcatctatcagtaaaacaacgaccagtgaaccagcaacaggatggtacaagcttgtcagagacagagatttccactgtatcacctggggtgcctagtacaatgctggcatttatgatgtaccaggatccgtgctaagctctttacaag

SEQ ID NO: 54139 - DNA, 397 bp, Homo sapiens
gcagagcctgctctatgccccgggcagatccatcacgtaaatatgtagcacaaacctttctctcccactagcatgctgactaagcttaactcacagggaaggatgtggctttcatgtctgaggctccagagcacagagtgtggcaccagcaggggcccagtcagtatctgcttgtgaataagcctgtgagctgaggcagtaccctctacattcaagtctgtcctctgaggtcttctgggcatcttgagactgtgggttccctgaatggctttgggcatacccagcattaagcactttatctgcttccttttgaaatatgtggttgatttaccaagcatttctagagtgctcactaagagctggctaggtaaccacttaataaatacttgattcaatt

SEQ ID NO: 54140 - DNA, 142 bp, Homo sapiens
agtggagactacagtgatgatgcaaacagcctgcttcacggctgctccccatcagcccggacctgtcatcagccttgacctgtcttctgaaaaacactccatccctgtcctccctgtgtcctggaggagggacctgaagccc

SEQ ID NO: 54141 - DNA, 1025 bp, Homo sapiens
  misc_feature (815)..(815): n is a, c, g, or t
  misc_feature (820)..(820): n is a, c, g, or t
  misc_feature (824)..(824): n is a, c, g, or t
  misc_feature (831)..(832): n is a, c, g, or t
  misc_feature (836)..(836): n is a, c, g, or t
  misc_feature (838)..(838): n is a, c, g, or t
  misc_feature (843)..(843): n is a, c, g, or t
  misc_feature (846)..(846): n is a, c, g, or t
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgatttcttccagaccatggctggagaaggaaagaagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttacacattatgtaagctgttaataaaatttctgtaggtgctacatatttgttaaaattttggttgtaattttaagctcactgtaggcagaaaggaatcattaagatttctattctttttagtctgtatctaaatgaccatatattttaattccaaatatttactttatacttcagtaatgcccatgtgtatttgcaaattatatgtgctttattgaaatatagnttttntagnctgaagnnattntntagcnatngtgtatattggtttggaagaagagccggccttttgggaccggtaatcggggcttaaggatttttaattccctaagcctataaggggggttcgggaggcgcgtaagccgcgtggaaaaaaaaaaattggcccggaataaatgggggggaaaatgcaggaggggttacgcgcagatgtgac

SEQ ID NO: 54142 - DNA, 990 bp, Homo sapiens
  misc_feature (780)..(780): n is a, c, g, or t
  misc_feature (785)..(785): n is a, c, g, or t
  misc_feature (789)..(789): n is a, c, g, or t
  misc_feature (796)..(797): n is a, c, g, or t
  misc_feature (801)..(801): n is a, c, g, or t
  misc_feature (803)..(803): n is a, c, g, or t
  misc_feature (808)..(808): n is a, c, g, or t
  misc_feature (811)..(811): n is a, c, g, or t
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttacacattatgtaagctgttaataaaatttctgtaggtgctacatatttgttaaaattttggttgtaattttaagctcactgtaggcagaaaggaatcattaagatttctattctttttagtctgtatctaaatgaccatatattttaattccaaatatttactttatacttcagtaatgcccatgtgtatttgcaaattatatgtgctttattgaaatatagnttttntagnctgaagnnattntntagcnatngtgtatattggtttggaagaagagccggccttttgggaccggtaatcggggcttaaggatttttaattccctaagcctataaggggggttcgggaggcgcgtaagccgcgtggaaaaaaaaaaattggcccggaataaatgggggggaaaatgcaggaggggttacgcgcagatgtgac

SEQ ID NO: 54143 - DNA, 937 bp, Homo sapiens
  misc_feature (727)..(727): n is a, c, g, or t
  misc_feature (732)..(732): n is a, c, g, or t
  misc_feature (736)..(736): n is a, c, g, or t
  misc_feature (743)..(744): n is a, c, g, or t
  misc_feature (748)..(748): n is a, c, g, or t
  misc_feature (750)..(750): n is a, c, g, or t
  misc_feature (755)..(755): n is a, c, g, or t
  misc_feature (758)..(758): n is a, c, g, or t
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgatttcttccagaccatggctggagaaggaaagaaggtgtgtttgcctgactcagtgactatagagagaaccaagttctgcaggcctgtcacctaagtctcagcagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttacacattatgtaagctgttaataaaatttctgtaggtgctacatatttgttaaaattttggttgtaattttaagctcactgtaggcagaaaggaatcattaagatttctattctttttagtctgtatctaaatgaccatatattttaattccaaatatttactttatacttcagtaatgcccatgtgtatttgcaaattatatgtgctttattgaaatatagnttttntagnctgaagnnattntntagcnatngtgtatattggtttggaagaagagccggccttttgggaccggtaatcggggcttaaggatttttaattccctaagcctataaggggggttcgggaggcgcgtaagccgcgtggaaaaaaaaaaattggcccggaataaatgggggggaaaatgcaggaggggttacgcgcagatgtgac

SEQ ID NO: 54144 - DNA, 653 bp, Homo sapiens
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgatttcttccagaccatggctggagaaggaaagaaggtgtgtttgcctgactcagtgactatagagagaaccaagttctgcaggcctgtcacctaagtctcagggcggggagaccttccttccccacgggtttgaggctatggctaagtggtgagccttggtgagacgcagaaaggatccatcccaggcacttggctagaggtaagtaaaaatagcctttgggccagaagacctgatagtttgggtactcgtctggacataagtccccatcttcccagaaatgtcgtcttttgtctgcaacaactggctggagaaatatttcagaaagatgtgtgcctggaacacccaaaggcatacctttcctttctccttggcataggcctgcagcactgaagaaagaccaggtttgcaacggagccttcaatactcttcatcctatggatctcaggggctcatagggtgacaggag

SEQ ID NO: 54145 - DNA, 410 bp, Homo sapiens
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataatgtgacatacatctttgcccagctcctgagtgttttagctctggttcctgtgtccagctcacagaagggattctgatatatcactgaagccagcacctagatgatgc

SEQ ID NO: 54146 - DNA, 2184 bp, Homo sapiens
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaggaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtatctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggcctgaaagacaatatcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgttgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcctattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggattttttttgccttgtaatttccatattacataataatgagataaacattaatgttttcagggtactttaaattttagataattactcattgtattcatggtgaaatttgtttttactgcatgtgtggtttggaggactgttttcacttctgattcatctttactcttatctcatcagagctcatacctcttgtagttgggggattcgtttataattccataaatggggcaattcataataacataatacaatgagtttgaacgcaggacaggtcttcaagcatacacacatgggcctacatatgtacaacaataataatttataagttactgtttggatggaaagtaaaagtacagaaaatttgttaaaggaaattaaaatggagatcatgtctcataatctctgagcagacaaattagttaggtctcataagtgatctcaacctcgcttgatttgcaatacaacaaacttaaattatttcttgtagctgcatattgaaaaaagagaaatgaagctcaaccgtcagaagtagccacaaccttatataaatagaaactgttcaacaaggtaaacagacaacaaaaacaataaaaaaagttgtgctacccg

SEQ ID NO: 54147 - DNA, 2242 bp, Homo sapiens
ctgcatttggcgggatctgtgtctctcgctggtgctggcacaggaacttgggatccgtctcctctttcgcctcctgcaccttgggagccccgggctactctttcacagcccctgttgccctgtgatctgtaggtccttggggacgcatagttaaggtgccaggacatcctggaagctgggaaatgctgaatgctatccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaggaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtatctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggcctgaaagacaatatcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgttgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcctattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggattttttttgccttgtaatttccatattacataataatgagataaacattaatgttttcagggtactttaaattttagataattactcattgtattcatggtgaaatttgtttttactgcatgtgtggtttggaggactgttttcacttctgattcatctttactcttatctcatcagagctcatacctcttgtagttgggggattcgtttataattccataaatggggcaattcataataacataatacaatgagtttgaacgcaggacaggtcttcaagcatacacacatgggcctacatatgtacaacaataataatttataagttactgtttggatggaaagtaaaagtacagaaaatttgttaaaggaaattaaaatggagatcatgtctcataatctctgagcagacaaattagttaggtctcataagtgatctcaacctcgcttgatttgcaatacaacaaacttaaattatttcttgtagctgcatattgaaaaaagagaaatgaagctcaaccgtcagaagtagccacaaccttatataaatagaaactgttcaacaaggtaaacagacaacaaaaacaataaaaaaagttgtgctacccg

SEQ ID NO: 54148 - DNA, 6049 bp, Homo sapiens
  misc_feature (811)..(811): n is a, c, g, or t
ggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgangattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgagggagctggctctgcaaatgaaaaccaacctaaaaagatgttcacttccagtgtccataaacaggagaagacagcacagatgaagccacctaagcctacaaaatcagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagcctaaaaaaaa

SEQ ID NO: 54149 - DNA, 646 bp, Homo sapiens
  misc_feature (42)..(42): n is a, c, g, or t
tcatatatacatagttaatagaatggtatgtagggtgtacgnagaactgctatattcatcctatgtgggtaatgaggagtatgctaagatttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagcctaaaaaaaa

SEQ ID NO: 54150 - DNA, 698 bp, Homo sapiens
tttagaagtctggcaccaaagggagaagagtttagaaagcactagagcagggggatcagaggaaacctgaaaggaggaaacattatatggcattccataaacaacataccccaatatctctggggttccttattgcttgtgtgttatttgctgtggttccagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgtttt

SEQ ID NO: 54151 - DNA, 393 bp, Homo sapiens
aggctgcagtggggtgcagggcagtcagactggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgagggagtggatctgattgccgtcaatcaataatacctttgaccaagggactccaatcaattcagcatgctttgcctaatgccttttgtttgtaatactgttgcgggacaatcaaagactggagagaccaaaaaaggttcaggagagtttattaaattaaggtgaccactggctcagccagaaatatgt

SEQ ID NO: 54152 - DNA, 1472 bp, Homo sapiens
aggctgcagtggggtgcagggcagtcagactggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagtgagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcgctggacccacagtttctttcccagacaccagagggcaggtcctatcctcaacttgagaaaaaaaatgacaggtccttattaattgagcacttaatatattccaattgcttcacctgccttatccccttccat

SEQ ID NO: 54153 - DNA, 608 bp, Homo sapiens
tcccctccctactttcgatcgcggagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcgaatgcggatttgtgcttggatgaaggcagttgcccgtgacggaattgatcctgttctaccaccctatcctccagacttctcacgtatcgaagtgtggggatcgtct

SEQ ID NO: 54154 - DNA, 2450 bp, Homo sapiens
caagcagtgagaattcttgttgcttccttcctgctctcctcaccccacgctgattgctttgaggagtatcaaagatctaagcctttactgtaggtttttaattggtcaatagaaagtagtgtccctgctgaaaggtctctttttaaaaaattttctttccttcttttttcttttttttaattttgagacagagtcttgctccgtcacccaggctggagtgcagtggcatgatctcagctcactgcaacctccacctcctgggttcaagcgattctcctgcctcagcctcctgagtagctaggactacaggcttgcaccaccacacccagctaattttttgtatttttagtagagatgggattttgccatgttggccaggctcatcttgaactcctgaactcaagcaacctgcccacctcagtctcccaaaatgctgggattacaggtgtgagccaccatgcctggcctcaaatgcctctttaaaatgagattcattcatcttcttctctgtgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttctcaccaccatccgccagacttctccgcgatcagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 54155 - DNA, 792 bp, Homo sapiens
aggctgcagtggggtgcagggcagtcagactggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccaggtccaggagagggagaaggagagggagggtgggggtgaggtgaacatccaggacacacgagaaaaggatgacctgacttgggggctcagaaatgcagcttatccctggaa

SEQ ID NO: 54156 - DNA, 2938 bp, Homo sapiens
aggctgcagtggggtgcagggcagtcagactggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagtgagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttctcaccaccatccgccagacttctccgcgatcagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 54157 - DNA, 2100 bp, Homo sapiens
tcccctccctactttcgatcgcggagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttctcaccaccatccgccagacttctccgcgatcagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 54158 - DNA, 906 bp, Homo sapiens
aggctgcagtggggtgcagggcagtcagactggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagtgaaggaaagaaagatgaggtgaaaggaaggagaaaataggaggaa

SEQ ID NO: 54159 - DNA, 1959 bp, Homo sapiens
  misc_feature (1)..(1): n is a, c, g, or t
naccagatcgaataaactcctccacccatcattatgatcttcgggctggcatgttaaaacttgggagagacagagtcactctctcacacaggttgagtcagtggcacgatctcagctcagtgcaacctctgcctcgtgggtcaaagccatcctcctgcctcagcctcctgagttgtgaggactatggaagtgtgccaccatgcctggctaattttttaagtttttggagagatggggtcttgctctgttgcctatgctggtcttgaactcctaacctcaagcaatcttcctgcctcagcctccccaggtgttgtaataataggtgcgagccaccatgcccagccttgtgttgcctcttggtaagaaataataaaaagaaattagtagcttgtttacctggtaccagatttggagggggctgagtataatttttactgagtggtatgtggttggaaaataggccacatttagccttgaattgtttagaaatcaaatgcgattcagaattgaagaggacattgctgggctatgaaatagggtactaacaaggctatttttgtagcaaaatggccaaaagctgaaataaatcttcttagtctgtgatgcttgtagcatcctttgttaagtaaagcacaacaccctggacaagcgactagttatgacttccaaatagattgataatagccttgcatgttgtagttagagacactgtagctgtatctgtatacctgtaatatagcctgggaagttctgttgctgcagagttatcattaaagtcacttggaattgaaaaagatacagagtgttgagacaaaggaactaggctggcacagtcattgctgatgcgatgggttctccactttggctccaggcgaaggctcctggtggtgatgcatgattgatttcaggtctttgtttcattttggcttcattactgtgattctgagccacacaggtttttccccctggggagaagactatgtaaaaatctcagcgttagaagctgtgttcagtgccctatatgtcttgtgaacctatctgagctgggctgagagcagagtggcttactgtagcagctgtggatgcagtctagttggaggcatggcttggaggacgtcatggttcatgcgatggttggagggatggtaaaagcagttagctcttgtcagctgcttccctctgctagtgcttgagctgccaattttatttgtcagtatttcctgatctcccactcctgttgtgaaaggtcacagagttactgtcactggcaacaatttcgccccttagaagaaaactggtacagagggaaagggtgaggaaaatggtgagttccatcactcagaactaaatgcaagtggcagagagatgctttctcctgtgttaacgtctccaaaagatgaacatcaaatgcccggaaacagcaacatcaaaaagaaggaagatgagaagtattgttgaagagtatggacctacagggtttttaacaagtccagcaaaacaaactatggccaaaagaagaaatttttctgtcactgcgagtagacatcataaatgcttggtaaaattgccagatttagggaataaaaaatttttaaagtacagtgttgaagaatggggcatgtcatgaagacattcagcaaagaagcaatcttggcaaggtggagaagtgggaagcaatggggagagaaagggagatgcccagagcaggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtata

SEQ ID NO: 54160 - DNA, 2164 bp, Homo sapiens
  misc_feature (1)..(1): n is a, c, g, or t
naccagatcgaataaactcctccacccatcattatgatcttcgggctggcatgttaaaacttgggagagacagagtcactctctcacacaggttgagtcagtggcacgatctcagctcagtgcaacctctgcctcgtgggtcaaagccatcctcctgcctcagcctcctgagttgtgaggactatggaagtgtgccaccatgcctggctaattttttaagtttttggagagatggggtcttgctctgttgcctatgctggtcttgaactcctaacctcaagcaatcttcctgcctcagcctccccaggtgttgtaataataggtgcgagccaccatgcccagccttgtgttgcctcttggtaagaaataataaaaagaaattagtagcttgtttacctggtaccagatttggagggggctgagtataatttttactgagtggtatgtggttggaaaataggccacatttagccttgaattgtttagaaatcaaatgcgattcagaattgaagaggacattgctgggctatgaaatagggtactaacaaggctatttttgtagcaaaatggccaaaagctgaaataaatcttcttagtctgtgatgcttgtagcatcctttgttaagtaaagcacaacaccctggacaagcgactagttatgacttccaaatagattgataatagccttgcatgttgtagttagagacactgtagctgtatctgtatacctgtaatatagcctgggaagttctgttgctgcagagttatcattaaagtcacttggaattgaaaaagatacagagtgttgagacaaaggaactaggctggcacagtcattgctgatgcgatgggttctccactttggctccaggcgaaggctcctggtggtgatgcatgattgatttcaggtctttgtttcattttggcttcattactgtgattctgagccacacaggtttttccccctggggagaagactatgtaaaaatctcagcgttagaagctgtgttcagtgccctatatgtcttgtgaacctatctgagctgggctgagagcagagtggcttactgtagcagctgtggatgcagtctagttggaggcatggcttggaggacgtcatggttcatgcgatggttggagggatggtaaaagcagttagctcttgtcagctgcttccctctgctagtgcttgagctgccaattttatttgtcagtatttcctgatctcccactcctgttgtgaaaggtcacagagttactgtcactggcaacaatttcgccccttagaagaaaactggtacagagggaaagggtgaggaaaatggtgagttccatcactcagaactaaatgcaagtggcagagagatgctttctcctgtgttaacgtctccaaaagatgaacatcaaatgcccggaaacagcaacatcaaaaagaaggaagatgagaagtattgttgaagagtatggacctacagggtttttaacaagtccagcaaaacaaactatggccaaaagaagaaatttttctgtcactgcgagtagacatcataaatgcttggtaaaattgccagatttagggaataaaaaatttttaaagtacagtgttgaagaatggggcatgtcatgaagacattcagcaaagaagcaatcttggcaaggtggagaagtgggaagcaatggggagagaaagggagatgcccagagcaggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataattctttgcagaaactgttaatgtctttatttctcatattttttttcccccctacaagctcctgaaagatctttttgaagaattgacaaaggatgctatcaagggctatgtttaggtggatggaaataacctcttgaactcctaacctcaagcaatcttcctgcctcagcctccccaggtgttgtaataataggtgcgagccacc

SEQ ID NO: 54161 - DNA, 726 bp, Homo sapiens
ctagttggaaaaggggacttgaagctaagtttacatggcactttaagactgagaacatgtcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataattctttgcagaaactgttaatgtctttatttctcatattttttttcccccctacaagctcctgaaagatctttttgaagaattgacaaaggatgctatcaagggctatgtttaggtggatggaaataacctcttgaactcctaacctcaagcaatcttcctgcctcagcctccccaggtgttgtaataataggtgcgagccacc

SEQ ID NO: 54162 - DNA, 519 bp, Homo sapiens
tttatcaaagggaggtgggtgggcatgaatctagttggaaaaggggacttgaagctaagtttacatggcactttaagactgagaacatgtcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgcttacagggacttcccaggctgcacttcccttccctgtgggctgcacccgtagaagtatagaaaatgtaatgtctgttgaatataaaatcgtaccactgaat

SEQ ID NO: 54163 - DNA, 445 bp, Homo sapiens
gaagcatgtaagagagggaacatttccttagatgttacccagatggttctgggggagacagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcaaaccatctagattaaactcctaaagccagtgccacgaggcattcctgttccaactgggtgtttgagcagattggcaaaaaaaaaaa

SEQ ID NO: 54164 - DNA, 852 bp, Homo sapiens
ccgggctctagctgtttccctcaggcggcctgttccacgccaggattagttttgcttcgcagatgggccgtggtggtgagaggaagcaatcagtatggaaatggagaaatggcttaccatgcatgtccttctccccaggagggaggtcgtggtgcaggcgagcagacgccagactcctggacacttgccgcctgcgttatggaggcttagctaataaccttgcaggggtcttcaggcttttccactggctcacctttaggcttctgacacttttacctacgattgaaaaaagacgagattccatgagactagaaatgtaggagcatctcagaccttcacagaacgctctgttagaagatgagaaacataacgttgcttgtgagaggtgaagccagctggacttcctgggtcgagtggggacttggagaacttttctgtctagctaaaggattataagtgcaccaatcagcactctgtaaaaacacaccagtcagcgctctgtgtctagctaaaggattgtaaatgcaccaatcagcactctgtaaaatggaccaatcagtaccctgtaaaatggaccaatcagcaggacgtgggcagggacaaataagggaataacagctggcgcccctagccagcagtggcaacccactcggatcaccttccatgctgtggaagctttgttatttcacttttcacaataaatcttagggttgcttactttttgggtccatgccaccttgaagagctgtaacactcaccacgaaggtctgaggcttcattcttgaagtcagactaagaaccaccggaaggaaccaattccagacacacgtgtagtagcaaattatcaaaaat

SEQ ID NO: 54165 - DNA, 614 bp, Homo sapiens
  misc_feature (81)..(81): n is a, c, g, or t
  misc_feature (252)..(252): n is a, c, g, or t
  misc_feature (370)..(370): n is a, c, g, or t
  misc_feature (404)..(404): n is a, c, g, or t
  misc_feature (465)..(465): n is a, c, g, or t
  misc_feature (492)..(492): n is a, c, g, or t
  misc_feature (522)..(522): n is a, c, g, or t
gactctgtctcaaaaaaaaaaaaaaaaaaaaaaaaaaaaagtcctctcaggggcaccccattgaatccaggctgttattcngttattccgactctcactgtcctactaaaccttaagccagctggcccctttgtgtatctcctgtctcatttcagctaactgtccctcactaaccctttctccgctcccacacccacttgctcccagcttgctttcaccttcaggggctttgtgctagctgatccacttgcnaggtactctttccccaaagttatctcctatttgcatttacctcagtttaaatgttacacttctaaaatatcttttctggccgggaacggtggctcacacctgtaatcccagcactttnggaggccgaggtaggtggatctcatttgaggtcnggagttcgtgaccagcctggccaacatggtgaaactccatctttactaaaacaaaaaattngctgggcatggtggcacacacctgtantcccagctactcaggcggctgaggcagganaattgcttcaatccaaggggcagaggttgcagtgcgccgagatcgtgccattgcactcagcctgagcgacagagcaagacttcattcatctc

SEQ ID NO: 54166 - DNA, 299 bp, Homo sapiens
gactggctttttaaaggattttataataaaatttaaaataatctgaatactctttatattctaatgaagaaaagtattttgtgtgtacatagtacttgtgtgatttcccccacacttgaaaaaagaatcaaatctatttgtgtgaaaactattcttgagacaggctataatgcagtaatttaaatatattaagtatgtcagggtattctgagctgaattctaactagtattcattaatacaatggtatataattacctcagccagtagaaacttaattataaaggctatttggctgtta

SEQ ID NO: 54167 - DNA, 468 bp, Homo sapiens
caggggaaggaagatgggttggtgggtggatgggtgggtgacagatgaataaacagaaggaaaggaggaaggaggaaagaaagaaaagagggaggaaaggaggtaaggaaggaaacaaggaaggaagggagagagggagagatggagggaggaaagaaaggaggaaaggagagtatgcacatacatacagctggaggaacccctggttccactttctctgaggtcccccaaggtctcagccttccctgaggcttctctgccctaactccccctccctttctctttcctccatcacaaagccagcccctgacatgccctcaccccgcacagtgattactccttgagcagcctcccgtatcctgttcctgctcttcctacaagcagagaagcagaaaaatccatcctgatgaggaggcagccgcccgcctgccctcgcgcctcctccccccgcccctgcagcctgtaact

SEQ ID NO: 54168 - DNA, 725 bp, Homo sapiens
acaactttttgccaataaatttgcccataaatagaataaaatggaaaaattacttgaaagatacacattaccaaaactaaaaacgcaataggaaatctgaacagactttcctgaattcaaataaattcacaatttaaaatctttcaacaaagaaaatatccagtttcagatgacgtctctgatgaattctatcaactatataggtagaaataattaaatggagaaaagtattttcaataaatggtgctggaacaactgtatatatatgaaaaaatctaattcataatgatccatagacacacatcaaagctgaaactataaaaattatcgaagagaacacaggctgggcatgatggctcacacctgtaatcccagcaccttgggaggctgaggtgggaggattgcttgaggccaggagtttgagactaggctggggaacaatagtgagatctgttctctacacagtaaaatgtttaactagtgtggtggtgcatgcctgtagtcctagctattcaggaggctgaggcgggaggatcacttgagcccaggaggggctgtttctcttggatttttaaagtagacaatcatgtcatttaccaataatgacagttctctttccctttcaaccttcatatgttccaatcacttgtctttctgtatggtctggaagaatctcatggagaactggtggacgagcgtgctttctcttgttcctagcttaaaaa

SEQ ID NO: 54169 - DNA, 279 bp, Homo sapiens
ctctagtcccagctactgggaggctgaggctggagaattgcttgaacccgggatgtggaggttgcagttacccaagatcacgccactgcacaccagcctgggtgacaggatgagactccatcttataagaataaataaataaacaaacaaataaataaatcttccttaaggatatcagggaaacctccaaactgtgaatgtgtattacacttgggaaaaagtgtaaataagtcactactggaaccacataaactggccagtgaccctacttgtgtgact

SEQ ID NO: 54170 - DNA, 696 bp, Homo sapiens
tgcgtctacaccacctgcctgagtcacttaggagccattttggttatcagatcagctgttgagggatcatgatgcttgtgttccagttgccttattttactttacaatggccccaaagcgcaagagtagtgatgctggcaatttggagaaacagaaaccagagaagccattaagtacttcccttaagcgagaaggtggaagttcctgactaaagggaaagaaataacttttattatagtatcttgttgtgattgttttactatgagttgttgttgttaatctcttactgtgcctagtttatgcattaacttatcacaggtgtgcatgcctaggaaaacacatggtatatacagggttcagtatacacatggtatatacagggttcagggttcaggcacctactgggctcttggaacatacttttccggctaagtaggagctactgtgtcaaaaagggaatcaagagaccaccacaatcacggctgaaaggagccttgagaatggacttctcttcaggtggggaaactaaagcagagagagacgtggtctgcccacagcacaaggctggctgtgacaaccctcattcagttcatgctggaaggagtccttaggaagtgcacggacgggcctctgcttagtgcacccgacctctccatttcagccccttcatctgtgtatccccccatccccccagca

SEQ ID NO: 54171 - DNA, 752 bp, Homo sapiens
ccagccaagaaacacctttggacaattgttctgtggctcattagatctttttggaatcctgtgtgttggcttataccgaataattgatgaagaggagctcaacccagaaaacaaaaggtttgtgatcacccggccagccaatgagttcaagctgctgccttcagatcttgtgttttgtgccatacccttcagcactgcttgttataaaaggaatgaagagttctcattgcaaaagtcatatgaaattgtaaataaagcatcacagacaacagagacacattcagacacaaattgtcctcccaccattgattcagttactgagacattgtattcaccagtctattcttaccagccgagaactaactccctctcttttcctaagcaaatagcatggaatcagagtagaacaaacagtattatatcatctcagatacctttaggtgacaatgcaaaagaaaatgaaaggaaaacttcagatgaggtttatgatgaggatccctttgcatattcagagccactatagacctgcccatattcttcacgtgctcttaacttgctgcttacaaatcatctcctgagatgctaactttgaacaaagaaaataagaatggaagcatgccatttttctgcccattgcttagtggttcatgaaggccacactgttttgggtgagacaaaagtctaatgccactggatcttgtgtgataaataaagaaatatatgatcaaagcttctgtaaggaaagttcattg

SEQ ID NO: 54172 - DNA, 928 bp, Homo sapiens
tgcttaagtctggactgcggaggccggggcggtggcgtgcagggtgaggtctcccgggctggcgcgcgtgcaagccccctgctgctacctcgcgctaggccagctccaggagggcaacagacgacaggacatttcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgatgaaacagagaaaccatgtcttctctccgaatataccgagaactaccctttctatcactcctacctgcccagagagtccttcaagccaaggcgggagtaccagaaagggtctataccaatggaaggcctgactacatcaaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccacc

SEQ ID NO: 54173 - DNA, 372 bp, Homo sapiens
gcctgcaccatccaaatagttatttactacatagcctgaaaaacccatccaatgtccctgtgaaggattcattcttacatctcatatatgccacaaatatgtcccagagtggaataatacaggcatggccatatttgccagtcggtgtcctcccttcaacaaccaagagtcaagcccagtgatctttcaccctatgcctgcccttcacatcagcccctaccgacagtcccattcttcagaactcaagtgtagttgactctctcacacattacactcacttgtataaatacccaggggatgtcagttttccttagatctgtatgatcttaatagattattaaataggtccaggagccacaccggtaaggatct

SEQ ID NO: 54174 - DNA, 333 bp, Homo sapiens
gaatctctgttcctttcaaaggggtaagatgactgcactcataagttcagctcacaatgttaatggaagataggatttcatagtttgcaagagttaaaaatatgtaggaactttacttataatccccagcacctatttagattctctggtgggcatcagctacaaagacgttgtcctgcctggaggaactcacaggctggcagtggagatggcagatggcagagctctcgttgacagtcttctttcactttttgagtcattttggaatgcagtcagtttcatgtgcgtccgtgtgaagagaccaccaaacaggctttgtgtgagcaataaagc

SEQ ID NO: 54175 - DNA, 279 bp, Homo sapiens
taaaaaggaactcttctgaatagtcttttaaacaaaaacaaaacaagcaaacaaaacaaataaaatagacttctacgatggtagaaggactttaaatcagaaaaaaataaaataatgagaattctgaacattaaatatggtagaaaattcaaatagatttgataatattcttttcaaaacatatttatgtattgtaacagataacaaatgagggttaaatatataatggatcacactgattttgcatttgcctcctatacctactatactattatttga

SEQ ID NO: 54176 - DNA, 523 bp, Homo sapiens
ggagcctgcagcaaactagttggaatgtgcctcttgtaaaagtagcctcactgggttgtgggcatggtaaagaggatgaagagacaccttctgagcagaatgtttctgtgggagtgtcacagtttaaggcaggttcatccacactgaagactcaaccccgggagatatatgttccattcctgaaagatatcttgcctctggctaatctccctgggcgggaaccttacttggttggagcacgtgcaaaccagtaccagcaccagaaacatcacagtgcaaagaaatccttgaagagggacatggacagagcctcagaccattaagcttcagatgatcatgcaacaaagcttccagccagttccaggtgaagacaccacccctggtcatcaagaagctgccctgcctcaactagatacagcaggatgccaagaacctggacacccaccaccgttaacaccagggatgcaaggttggttcaacatatgcaaatcaataaatgtgattcatcacataaacagaaaaa

SEQ ID NO: 54177 - DNA, 1258 bp, Homo sapiens
aacaaattctgcagttgagcttcaaatgagtcagatatgcacatgtgcccattcgcctatgatttcctgtagcaaagttaataactatggtgtaaggatggaagagtcatagtcatttttctccctcctacctttagtacttagtcttccctcacatttgttctctgttttcagttattttgaaattatattaccattaagaaattgtgagtattatatggggttttttaaatacttaagaagactcttacaatttaatagtagttgaatatttctgtttataaattgggaaaaacacaatgtaaaagaagcaagatggctggctgggtgaggtggctcacacctgtaatcccagcgctttgggaggccaaggcaggtggatcacttgaggtcaggagttcgagaccagtctggccaacatggtgacaccccatctctactaaaagtacaaaaaaattagctgggcgtggtgatacatgcctgtaatttaaaaaggaaaaaaaaaaaaaaaaggaagcaagagccttagaacttacaattccagatataaaatcaagtatactgtccagtggattcagctgctggatgtttcaagtaattaattgatgaaaattatggaatatactagtccagcatacttgacctacccttgtatcatgaaatagtctataaaatgaagcggcagtaggagggcccatttaataacataattatctgttcctttattatttctgttacagaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54178 - DNA, 1340 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54179 - DNA, 1312 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54180 - DNA, 1491 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggtgcggaaggtggcgggggaggggacggtcggccgaaggctccccggggcgggccggcgggagtcgtagtcagtggtgatttcttctggagtcgtttcctcagctccttccagccccttgggcggcaccttctatctttgaggcgttaaaggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54181 - DNA, 1234 bp, Homo sapiens
tggtgcggcgattctagagtgatccctgcactgtagatcgctcgagcgcgtataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54182 - DNA, 1287 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54183 - DNA, 1265 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatgctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54184 - DNA, 1206 bp, Homo sapiens
gtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcagaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaaaatc

SEQ ID NO: 54185 - DNA, 428 bp, Homo sapiens
ggcttcccaaccgtcacctctcctttgagtttttcagtatatatcttcctgaaattggctttaaaaagcttcaaggaggaaaaaattttgaagtgtatcctgcttgcctaagccttacccatgacctaatgttaactctttttgtgtggtccccggttgtgagcagacaggctggaactaaagcacacatggcagtgcaccaacttgactcctgtcataaaactgataaaaggtgatctgttcatcttcttaagtactcttagcactattattcatgacatggtacttagacacaaatgtacacaattctaaagcagatcattcaagtatttcatttttcctcatctttcttcttcttccagtacatataattgacatacacatatgttgagagctttcctatatttctttaatcactgtcaggatca

SEQ ID NO: 54186 - DNA, 86 bp, Homo sapiens
aatgattatttcggactctgagtcttggatggtcgtctctacaagctcccaaaggaaaacacccatgtggtttttgcctgcttgag

SEQ ID NO: 54187 - DNA, 354 bp, Homo sapiens
agctaaggtggcaggagtgtaggagacagggagaaacaatagtaaacgatgaggtcagaaatataggcaggcgtcaaggccaggggcagtggctcaggccggtaatcccagcactttgggaggcctaggtgggagtatcacttgagcccaagagtttgtacaccaggctaggcaacatagtgtgaccccatctctacagaaaaaatggaaaaattagccaggcatggttgtgcatgcctgtagtaccagctactatctggggctgaggtgggtgcattgcttgagcccaggaaggagattgaggctccagtgagtcatgatcatgccactgccctccagcttgtgagacagagg

SEQ ID NO: 54188 - DNA, 628 bp, Homo sapiens
caaagctgtcatccgacagcacataaagaccagattatctcatttgtgtcccattttgatcataaaatagttcaatgtatgtaacattttccttaaagcagtccaaatgtaaaaaaagaagttggaacctgcaacacattccggaataatttggaaaccttgatgcaatccagactcacctggcaccctttctcttccctaaaacgtgccttttttccatttctttttgactttgagaaaaaaactctgttcttactggtaaaatagcctcctgtttccttttctttcctgtaaattatgagataagtttgcatttcatacctttccagaaatctctgttgattgtggtctgacctcagattcatgatttctgggaaagaaagaattagaatcactgctgtgaacattagaagtgcggtgagtagttcgtgttgtggatttgagatggaaaacaggtgaccagtacctgtttgttgttccggaacttatttcctggtgctgctagatggtatgccggcaaccacgtccaactcatgccaatgacttttaaaaatgtcatctcaaatgccacatgttatgtcttggatgtagttagggctagttgtggcctttttgtatggtagaaacc

SEQ ID NO: 54189 - DNA, 667 bp, Homo sapiens
gaacttgagagcctgtcaacccaggtgtgtaggctgaagcaggtcctgactgttccacagaactctctggccctcagctcccagaagcaggggcacaaggggcctgggccccatcgttctcaagcttgccccatgtttttttatccaaagaatttgttaattatttatgaagagaaactacttattagcccatatattcatgaatagttcagatcagtgacaaacttctaagtaattcaacccaaagaaattcttcatattccaaaatcactttgcattctgagagatagcagccttcctcatctcctcgaagtatttcaatggcatcataacttctgtagacatctgtgccccatagaaatctgaaaatgccttctttcttggtccagcccctgcaaactgagagagccgcagcccccagggatacagtgaatgctcccacaatatgaaattgcagaatggtggccagaaggccacatgtctgaggtttcatgaaagcactggaaaccatggtagttactgttcttgataagtatgtcggcctcaacaccagtgcccttcctggctgatgaagaaatggattgccacttgccctgaaaggatgtcagctgcccagctcagtggctggctgagcatctggttcccctagcccaatcccacactccac

SEQ ID NO: 54190 - DNA, 309 bp, Homo sapiens
tacataccttgcatttcattactgggtctcgatctaatatttttccaaatcctatcaaggtatggtagtgtattcacttcagctaacaaattatccttcacaatagaattttaaatgaaactttaaatgcattaataataactttctgtttatggacattagctcaagttgagtcttaggagtatatcacattataccattatctgtgtggatatgaaggaatgtatgtatttaacattttacatgtactgtttactatggtctgcatgaagatttatgcatgtgggttcatagaaagataatgggggc

SEQ ID NO: 54191 - DNA, 564 bp, Homo sapiens
gttttgtggtccttgttgcatgccccagaaagggactgaagtaagggtgcctcagggacacaccctgtaggatgaagcacttagcgagaaagtggggggacagaatgtgacttttcagtgtggcaggatgagaaaatttagtcaccttccttaagactaaaggaagagtgattttctagaaaactcaggttcatgaggaaagtagttgattcaggggttggtagggaagaaggaaaaatagattgagaaagagcagccgcagtttaggttagaacactttgcctgtggtaacatagggtgctcacggatgggaatatactctctgagataacttatgcggaggcatgtaactgatcactagctccagcatatctgaaaacatgacctaatagaatctctgtaccttatgccatttcatattataaaacctaaaatctaataggagcccttgttccaaaacagtttatatgtaggcagataatatctaaagaatatagtattttatcctaggtactttttacctagggtacagtataatatcctaggatatttgaataccaatgg

SEQ ID NO: 54192 - DNA, 393 bp, Homo sapiens
gtaaatttcagaggcagaacactccctgtgagcccgaacctcttcctgctttgttgcagtcttcataacgattgctttaaaagactgcattgatataacatcatctctcttctctgcatctttgacttgctagcttaactggtctagaggagggcttagcactgattttcagtattcattttcctcaaaacttcaattcagcctgggtttcttcagcaggagggctcgggggaaccagagccagggaccagagtcatttcagtgcaccagctcaagaaatgaatattccaggccaagaatccccaagtgttctttctgaagtccttcctggtggagctcaaagagatgaaaaacgcaagcccgcttttcagttcttatcaggaaactgcatag

SEQ ID NO: 54193 - DNA, 226 bp, Homo sapiens
cacagagtacaagagctgaggcttggaagcctctgcttagatttcaaaggatgaatggaaaagcctggatatccaggcatccaggcagaagcccactacaggggtggaaccttcatgaataactctattggggcagtatggaaggcaaatgtggggtcagagccgccacacagagtccccactggggcattacttagtggagttgtgagaagagggccccagaatg

SEQ ID NO: 54194 - DNA, 814 bp, Homo sapiens
tcttgagctaggaaaggattactcgcgcctcgttagaatcagacatggcttcaggggatgcaggacgctcccctgagctgcctgtcaccgactaggtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcaaaaaa

SEQ ID NO: 54195 - DNA, 891 bp, Homo sapiens
tcttgagctaggaaaggattactcgcgcctcgttagaatcagacatggcttcaggggatgcaggacgctcccctgagctgcctgtcaccgactaggtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattgaagtcctcagcacatgttcttcatggaggtcatctttccctggactgcttggctactttagaagtcaaatcaagactagaagtatgaaagccaatcacaatttcccaacaattaggatccatcattcaccatttggttggtccctgctgctaagaattccaaactacaagggaaaaagttaaactcagctagatttccctgcctgctcaagaccacaaccccagtggcaacataattcttggtgaggatgaaaaaacgaaatctatacttgccttgagaaagcattcatgcaaaataaagcccagattcataagtaatc

SEQ ID NO: 54196 - DNA, 762 bp, Homo sapiens
tcttgagctaggaaaggattactcgcgcctcgttagaatcagacatggcttcaggggatgcaggacgctcccctgagctgcctgtcaccgactaggtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcaaaaaa

SEQ ID NO: 54197 - DNA, 269 bp, Homo sapiens
aggcgcccgccaccacacccggctagtatttgtacttttagtagagacggggtttcaccacgttggccgggctggtctcgaactcctgacctcggctgatccgcccgcctcggcctcccaaagtgctgagatcacaggcgtgagccaccgcgcctggccaaaaattatttattttttagttgacaaacaaaaaccagagtctgaatgttacctgctctacagtggcacctgctaaagtttgagaaccactgccctgggtggccacatcg

SEQ ID NO: 54198 - DNA, 198 bp, Homo sapiens
ctccccaaaaaccccctaggctttactgttcattgttccttcccaccaacccctggaaaccactgatatttttcatttagaagggatttacaatcactggtatcttttacttctctgtaattttgcctttttcagaatattatacagtttgcaattatacagcatgtagccttttcagaccggcttcttcacttaaca

SEQ ID NO: 54199 - DNA, 4255 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagaatccattagaggacacactctgattaaaaattaaacagtaaaagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctaaggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctca

SEQ ID NO: 54200 - DNA, 3617 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggtaaatcagatttcacatccctttgaattgtacggtgaacaaatgatgacagattattactcaacaatgtcaatgataatatcactaatgtttattgagcacttactatgctaagcagagtttcaagtgccctcagtgttttaaatcatttaaacctcccaattctacagggctagggctgtcacaacaaactgagtgacttaaacaacagacaagtattgtttcacagatctggagactagaaatcagagatcaaggtgttggcaggtccgtgctccctctgaaggaactggggagggatctgttccaggactctctcctagcttctgccaattccctggcttatggcagtggaaatcaaatcttcatatggcgattctccatgtgtgcatgtctgtgtccaaatttccccgttttataaggatactgattatattcgcttagggacccactctaatcccatataacctcatcttagctaattacatctacaatgaccctatttccaaataagttcacattctgagttactgagggttagggcatatgaatttttaggggactcaattcaacccatcacacctatgatactattattctgattttatgtatgaggaacagagaggcacagcaggcaagtgatttgcctatggtgaaaaaaaatgaaaatgaattgttagtttccatttttcaaattcactttatcactctcactttacttttaggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagtaagttccactgtctttgaggtcatattacatggaagttaaatgctagttataaatcagaatttcccaaaagttttactcctcatatacctggaattcaacatcttttacctgttggattatcatagatgtggatgtccgct

SEQ ID NO: 54201 - DNA, 4209 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatacgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttgcgaatgaaggtacaggatcaggatttgccaaacactcctcactcaaaggctgtatacaaaatcttacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaaaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctaaggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctca

SEQ ID NO: 54202 - DNA, 2087 bp, Homo sapiens
  misc_feature (2057)..(2057): n is a, c, g, or t
ccttcccctcaggtcctgagtgaggcagtggctctctggcggtgctcgcatttaaataggagtgtgtaggcttacagcaatgaaacatctaggagcttttaactttggatctatacctgggtgtgacatttccttggtgttctctggctgcctttctggctctgcagccctgagggcacttgtgtgtgtgtgtgttctctggagaagggaagtgattatggcagagaggctcctttagattctcctcttaaacctctttggaacatgtttgaattccagaagtgaatgaacttcattcattctctcgtccagatttcagaagggactaaagtgaacggaggctttttcactccctggcatgctaagagccacattccctagctctgtgcctgcacagtgagtcttcagaatttggcccatcacaccctctgctagtatcgtttccaccaccctcctcatcctctgtcatctttatttcattctcatcgtttatctctacctccagttcagatgccatgctggctgtggctcttttcttcatcaccatcagagtgaggcaaagatgtatcctggcctagttataaagacgaataatacatgataagaaatcattaatttttttccacgtggggggcggtgctgtcctagtgattcatatatatataatttttgactccttacaataattctgggatgtgggtattacccccatttaagaatgtggaaaccaaggctctgatggctctgtaatttgcccagggtcacacagctaggaagcaagttgctgatctgcttggttccaaagtcacctctctttttcctctgagcacatttctaagccactacttagaagctcttgagataaagttggcctagctcaggtccaccgaggttttgagattgccctttgcccaaggaggagttgtgtccttggctcacctgtcatctgcctgtgactggacttgaaccctcgcacgtctcagctgacatccttgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgttgctgctcttcattccagcttctcctcacttttctctcagtctcttgagcttggaagccttactgtagcttgtgtctcctccctgggcacttgaggtcaggcttttgcctttttgtcacattgagccacatgcctttgatacacagttgtagcaaagaagggaggtgatgaacttgctcactttcttttctgatttccctccctactcatcctgcactccccaccgaaacccagatatcttatagtctaaggcttgtagaggattaaggaaaggaattggagatgggttttacttagttcacagaaaagctttctttgggatttttcctcccccttagggcttttaagtctaggtgaagtgaaagttcacacatgtgtttgtttggttgctctgtaattagctactagtttttatccctagaccttctctgctccagtgtcttgttcatgtgtcctgaccccgtgtccttgaattcccactttgctttgggatttaagttattgtatgttgtcaacaatatttaaagatgaaaaagtcctgaaggaaacttaccaggttctttcctttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgattaaaaaaaagcgcggttacagcgtaggcaacccgcggtcccacataccagggaaacacccacaagggagtgaaaaacgagacgaaccgagcagggagggacgcaccttaagcaagaccacacacaggcccaaataggggcgtcccaactatacgcacacacacgcgatagcacancgcgcgagagaagcgaagcacaggcacggg

SEQ ID NO: 54203 - DNA, 669 bp, Homo sapiens
  misc_feature (639)..(639): n is a, c, g, or t
atagacgtctgggcattctgaacccagaggtcagagtagtcacaagcggagccctggggagcgagggccccagggccgtggtgttccttgccctgcgctcactgaagtccaaggccaggtttcagaaatagtgtgctgcctgttcctgagatccttcacacctggacaccaacccagacaaagcctgacttaaaattttgatactgtattcatcgtggaatttttcaataactctgatttttaaaaaatactgcattgcaatatgatttaccttgattactgaggctcttttttttttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgattaaaaaaaagcgcggttacagcgtaggcaacccgcggtcccacataccagggaaacacccacaagggagtgaaaaacgagacgaaccgagcagggagggacgcaccttaagcaagaccacacacaggcccaaataggggcgtcccaactatacgcacacacacgcgatagcacancgcgcgagagaagcgaagcacaggcacggg

SEQ ID NO: 54204 - DNA, 272 bp, Homo sapiens
aaagtagagattatgctgtccagtatttgacataaatccagtcataaaatttggggacaaaatgatacagttagatttttctttcaaattattcagtggaagaactgcttagaattagcttcatgtttagaatgaaacttttatccatgaagtgcacattcatttgtagcctgatcagcaatttgcatttctgccattcttatttctctgttcccctgatgatcctttacttgtgcaaaaattcttagaaattgacaaggtgtgggggctca

SEQ ID NO: 54205 - DNA, 545 bp, Homo sapiens
atgtatagcacaacaatacagttctcatcatgactgtgcagctctaaaacatcatctgctaacaggtgatgacttatgtccttaatattatcttcattttataagtgagaaatttaaggtatagagaggctaaataacatctctaaaatcgcatagtaagtgataagagacagggtctctaggtttgcctcattcagcctcgtcccagagcacagctccagggagcacgccatttatatggaatgcctgtgaagagcgccccctggaggcatgcgatgcaggggctttttttccttctctttttgccaccaaccaaggccatacttgtagtccccctggtgtcccatgggtttatgaaaagagttctccatcattttacaatataatatgcttctctttgagtactagttgagtttttcttttctacgggaacatttttaaagctgttgaggactgttgtttcttttctacggaaacatttttaaagctgttgaggactgttgtttctttctcgaaacatttttaagctatcaattgaagctata

SEQ ID NO: 54206 - DNA, 344 bp, Homo sapiens
taagaactcacaaaccaactatctgctgacttcaagagactcacttaacacataaggactcgcacaaacttaaagtaaagcgggggaaaaaggcatttcatgcaaataggcaccaaaagtgagcaggggtagctattcttatgttagacaaaatgaactttaaagcaacagcagttaaaaaagacaaagagggacattatatagtgataaaaggccttgtcctacaggaaaagatcacagtcctaaatatatatgcacctaacactggagctcccagttttataaaacaattactaacagacctaataaatgagatagaaagcaacacaataatagtgggagac

SEQ ID NO: 54207 - DNA, 709 bp, Homo sapiens
tatttgcaaatcaaacataaagcctgaaaggaaacattacttttcattaaatagacggccagccgaatgaacagagaagaagtccggacagcttttcaatgtgatggattctgtggcaaggattacatcattggggggttttatatttctataattttagattagttattttagttcccttacccccatttttaaatattcctgtcagctaaaacaaggattttcttaggaaatgatgaagccaggtttaatttctacttagtgagaagactgcattaccaccccactgttaaggtgcaggtattgtcagtagggcaaggatgggttttcttttgtaaggaatgcatttgaagggatagattacagactcagggtaatgtgaacctgtttccatgcttgggaatgtcctcccaggtgatggacatcccttaggggaagcctcaggtaggataagcaaagcctaggttcttatttgcttgtttcttaaagaaacacaataataaagacaaaaatggtgtatggatcaaacagatgaaaccagaagagtgttaatatccagaaatgtattctctaagctctgcctaattatattaaaagtaatttgcaaatctggccctgagttttctgtaaccatatgaaaacaagaaacactatcagtcacaagattctgttatagcctgggcaacatagtgagaccccatctctgcaa

SEQ ID NO: 54208 - DNA, 854 bp, Homo sapiens
ttcagtccaccaagtttgtctcagaggaatctggacccagatgtgagatacaaaacttatttgatgctctcctggtgctaatatggttggactacctaaaattatgcagagatgattgtatatttagacattatttgatatggctgtttattgcctaataaaatcttgaagagaaactgggatgaaaaggctttacaatctacctctgtctccctttattgcagaagtccggacagcttttcaatgtgatggattctgtggcaaggattacatcattggggggttttatatttctataattttagattagttattttagttcccttacccccatttttaaatattcctgtcagctaaaacaaggattttcttaggaaatgatgaagccaggtttaatttctacttagtgagaagactgcattaccaccccactgttaaggtgcaggtattgtcagtagggcaaggatgggttttcttttgtaaggaatgcatttgaagggatagattacagactcagggtaatgtgaacctgtttccatgcttgggaatgtcctcccaggtgatggacatcccttaggggaagcctcaggtaggataagcaaagcctaggttcttatttgcttgtttcttaaagaaacacaataataaagacaaaaatggtgtatggatcaaacagatgaaaccagaagagtgttaatatccagaaatgtattctctaagctctgcctaattatattaaaagtaatttgcaaatctggccctgagttttctgtaaccatatgaaaacaagaaacactatcagtcacaagattctgttatagcctgggcaacatagtgagaccccatctctgcaa

SEQ ID NO: 54209 - DNA, 432 bp, Homo sapiens
tgctaactttacttcctaatatcccattcatgcatcaacccaatgtagagtagcttctattctaactactctaccaaagctgttcttctataccgttccactcctttcactcaaagtaccccatatttttgaagaatggtatcattcatgatacaatgttctctagtaagcagacttggacatggagatatatactagggagtgcccttgaatccaaggcactgtgaaaaggagaagaaggaagctggattgagggaaagggaaaaagctgggctgaaaagaagtcctgggaccacagctttggctcatctcacaggggacttttgaaggataaaatgggcccactggcattccttttcacattgcaatggacatggactgagtctttatagggccccaagtcccctccccacctctttcacctgcctcctt

SEQ ID NO: 54210 - DNA, 394 bp, Homo sapiens
aaatagtgagggcaccttggaccccagtgcccatgactttcggggcaaggatgggaggaaggtgtaggatgtctcttgccccactgtgggcccggaactgccaccccatcccaagaccacagcctccctcctacccaggcccccctgcggatccaggccaagacggagccctgcaggaggtcagaggaggggacttctttgcaccctgcgcctctttccaatcgccagagggcagggccctacccacattggggatgggaagacagcccctacccagaggcagggctcggggctctgtccagagtgctgacagtgacctgtgtgctcgggactcaacaccaccactccactcctgccccagcagatgggataaaaaatgaggggccacatcctc

SEQ ID NO: 54211 - DNA, 106 bp, Homo sapiens
ccggcagattatcagagaagcttcacccaaaagccacatctctcctccactcagccacaccgaccaaaaatgaatgaatcacatggtaataatcagtagcatggac

SEQ ID NO: 54212 - DNA, 514 bp, Homo sapiens
tacctttatgaatatactaatttaaatctggttttagttgtccttagtaaactatcatgttcttttagcttcatgtaacagtgatcttttaaaataatctaaagattaggtagtctaaaagttattttaatctttaatgttcaattagcttaattagtacgtagataatttgccttattttgactaaggacttttaagaaattataaattacttgtatatcaaaagttcccctaacaaagtaatttaagtctcagttgttatttcaatggcacaaaaaagtgactagtttagcaataaatgtcctaaaattacttttattgcgcttcgttaataacacttttgccaactaagtaatgaagaggataccattgtgcctgataaaaaaatcataggtccaagagtgtttcaatgatggaaaacatttcaggggaaaaaatcatgaatagaattgtcaagggaataaaatatactagttatggcatagtccaaaagtattaaatattatatattaca

SEQ ID NO: 54213 - DNA, 337 bp, Homo sapiens
tttaagttctgggatacatgtgcagaatgtgcaggtttgttacataggtatacgtgccatggtggtttgctgcacctatcaacccatcatctaggttttaagccccgcatgcattagatatttgtcctaatgctctccctccccttggcccccatctccgacaggccccagtgtgtgatgttcccttccccaaagtattttcttattcagactagttgcttctaatttatttaagatttttatagttaagtgaggcatttgttgattacacaaaacatgttattgatatttgtatcacatatgcacatttttttccttttaagtatggtataccgtg

SEQ ID NO: 54214 - DNA, 528 bp, Homo sapiens
  misc_feature (31)..(31): n is a, c, g, or t
ggaacccccgggcttcagaaatcggcacganagagagccaggaaagatccagagggaattattgaaatggctggtgaatacggaatgaattgccaaataaagtgcttaccatatcatttgtgattcctggaacaaaaggcttgctatgcagccgacgaggatgggattcgaacccacgcgtgcagagcacaatggattagcagtccatcgccttaaccactcggccacctcgtcacacaaagaatcaacaacttgaatttcttcgtctgtgtagtgctcccagtgagtcttgtagaaacatgatctaatcgtttttcctggtttaatccccataaccacagtctgagtcaggtgtcttaattaagacacatttcacaaccaccataaaaatgacgactgtcacttagagtagtgaagttacttggcaaatatctaataataggttgaaccagtgccggcattcattggtagacaaaaatcacctgcttttttgttgacccggctccagctggccgccctgtatgcccc

SEQ ID NO: 54215 - DNA, 161 bp, Homo sapiens
caaaagaaaaatcaatcactcaatcagccaatcagtctgttcagactgagagagagttaaggcccattaacttgagtagcctctcagtcctattcccaatctccactctgggaggtcactgactctattaaaaacacacatacagaaggctctgggggtgg

SEQ ID NO: 54216 - DNA, 260 bp, Homo sapiens
acaaaaagcaactttatgccccatcactagcacactggtagctacatcatatgtgtccaaaattctgagtgaagaaacgaatgaattaccaaagtatcaatttcaccttctctgtattgcccaaatgatcacttagctctactttgcaaccattaagagcctagattaccatcattcatttcctaaccccgctaataatgccttatcttgtctctactcagtcatgcccgtccttcttacagtccatccccaccatctag

SEQ ID NO: 54217 - DNA, 436 bp, Homo sapiens
aatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctga

SEQ ID NO: 54218 - DNA, 578 bp, Homo sapiens
  misc_feature (506)..(506): n is a, c, g, or t
  misc_feature (548)..(549): n is a, c, g, or t
aatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctgaaaaaaaaaaaaaaaaaaaaaaaaaaaaaaaaaaaaaaaaaaattttaggggggggcagggaccaaaaaangcctcaaggggggccccgggcgcgcccccacaagaacaaaanncctctggggggggggccgggacccaattg

SEQ ID NO: 54219 - DNA, 502 bp, Homo sapiens
aatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccagacctttcaaatccggagcctacttgttaggactgatactgtctcccttctttctgctttgtgtcaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctga

SEQ ID NO: 54220 - DNA, 357 bp, Homo sapiens
ctttcctcttatgatttcacactgccataagccagcaagggcatgtcaggtccttcagtttaaagagcactttgtattgtaagtttctgggcttgtggaaatgaatattccaatgatcacttactgtgtgtctggcgacatgtccctgagagggccttattgttgcacaagtcctgggtccctgggcaggaggcagggtctgttagacacatggtgttcctgtccctgaggcagcctctttgggcacaagaggagggtcttagtccattcatactgctataacaaaccactctgaatgggtgactgaaacatcagacatttcgcacagttctggaggctgcaaagtccaacctccag

SEQ ID NO: 54221 - DNA, 182 bp, Homo sapiens
gggttccaaggccctgccgtggaaggagatgaggctgggctgatacagtcagtgaagagtggaaatcttgcaggcgtgtgtgtgtgtgtgtgtgtgtgtgtgtgtgtgtgtgtgtgtgtgtgtaggataaacacgaggcctcagcaggcagctttcctcccaaactgcagaccctgagcctg

SEQ ID NO: 54222 - DNA, 231 bp, Homo sapiens
gtgttaccattgttgcccaggctggtcttgattgaactcctgggctcaagtgatccgcctgcctcagcctcccaaagtgctgggattacagctgtgagccactgtgctcagacaaaaaatattttttgtagttagccactgagtgcaggtcaacagaaggtcactcgagtaccttcactttatttttcatcgtgtaaattgtccacatagcccagcacctgtccctgctct

SEQ ID NO: 54223 - DNA, 410 bp, Homo sapiens
tgtgcccaagtcagcatgctctggatggtggattcagaggataaatacatccactttagtgacttgactgctagcaaaacaagtattcaatctaagtgacgtggtagccttcaaagttcctacatgtaacatgattaaaaattggtgagtcgactcttcatttgtccccagggctagccagtaaaatggcaagcagtttgattagtttataggatgatgaattaatgtgaagacttctatttactttgtgcagtaaaattaaatttcaaaatgagtataatacatacaatggaatactcttcagccttcaaaaggaaggaaattctaatgcaccttacagtgtggatgaaccttgagaacgttatgctaagcaaaataagccagaaaaataagcccccccaaaagtcaga

SEQ ID NO: 54224 - DNA, 770 bp, Homo sapiens
tcttgcttgttaataaccactgactgacagacttgcttttccataagtttaagcttttatcactgagagcccatctgttgccatccctcagaaagtcaagtacttgtgtagatggagtgcatgcacagagtatgttcctgaaagtatctcatgttttcaacatgaaattttctgtttctaagaccaagtaaagaaaataatttgcttttacacccgttagggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaag

SEQ ID NO: 54225 - DNA, 2224 bp, Homo sapiens
cgcggtccctctgcggaaggcgccgctcttggcttcggcggcgccgctgtagcttgaaggcggtacttcctccagcatttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaag

SEQ ID NO: 54226 - DNA, 245 bp, Homo sapiens
  misc_feature (1)..(1): n is a, c, g, or t
nctagatttgacagaactcacctgttaaatgtgaaagcttttgtggagtggagggactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaag

SEQ ID NO: 54227 - DNA, 1472 bp, Homo sapiens
tgcaatggcatgatctcggctcactgtaacctctgcctcctgggttcaagcgattctcctgcctcagcctcctgagtagctggattacagccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaag

SEQ ID NO: 54228 - DNA, 1037 bp, Homo sapiens
aatgagagaaattgcattgtggaatcaaaataacccaaactccactcagaaaagtcacaaatatatagtatactatctgatctcaaaagggaaaaacgagatgataagaccttaagtttagactttattttcttctcaagagtggacattaaatctattaacttgcaactttctgctgggaagagcatcaaaggtgggcctcctaaatcatttttgaaaaacctctgtcaagtccaagtggttccaggagaattatagccagtatcttttaaaatatttcattttagtgataatgtttttctctgcttcatttgcaatcaaccaggatctctaaaagactgcataagatatatgcacttttataggtggctgtcagctacacatagattcagcaaattttttttatatagtacctgtttttaagttaggctacataacttaaagtgcactttactaacaagacttgacattagcgtctacaatatgtatatgtaaacaaaagcacacaagaactaggcaccctttctctctccaagagtttaagtggtttccttaggttaaagaaggggacagaccagctaaaaatggttgtaccactcactgtacaacctcatggaaattctcactataagatttagaggcaatgttccctagctataagccagggcaagaaatggcgcctctggagttggggaacattaggggaacattacaaccgggtagatgctggttccctgaagtgtggggccatgaacatgcagggacccacggtttgaatgaaacagctactgaaagctaagttcaaaccacccttgcgtaacaaaggagtacagggtacacatcaacaccaatcacccagcaccccacagcgatggtcatgtcaccgtgcagcaggtcccttaccccagggctgccacatccacaagccttgcagtggcaaatacgctgctccttggatttaatgagatattttggttgcttaatgatgtactgatcagggaactgtctaaagctagtagggccaaggagttaatcaa

SEQ ID NO: 54229 - DNA, 302 bp, Homo sapiens
tgacactaattttggcctttggacaatttggcttaggacttagaagggcaggacctggtccaagaccgttgtgctgggtgaggtgctgcagtaggggatgtgtgcacccgggagggcagcctcctgaccacacagacaggatgcaggaagcatgctgttctccgaggcacggagcctcactcgtgtccgcctgccacagtgtaccgcaagcctgacagtcacggatggcactctcaccgtgtgcctcgccgtggcgtgggtttctgtgcatcgcgtcaccggccagcctagggtcaggtcct

SEQ ID NO: 54230 - DNA, 271 bp, Homo sapiens
cacataatataatctacaacattctacaacaaaatttctgatttaccacaaaaaatcagattttctaatgaacactttagaaagtatctacattttagaaacaatatctacagaaaaaccatcttttgttacttaatagctagttgagaaattcattcctttgagtttaattttatcattttattatgaaattgtacgtgatcacttactgtattctacagtgtttaattgtggagatacttgaaaacttttctcagtacctatgagctga

SEQ ID NO: 54231 - DNA, 639 bp, Homo sapiens
cagtggaacaaatactagaagtatgtggctaggggatgttaaaactttgtcccagccacaattgagagacctcccaggcatctggatgaaatgcaagaaagaccatgtggtaaagctggggtaagcaatactgttaaatcatagccatacttattcatgtatatgttgtttatggatgcttttatactacaatggcaaatgtcagcagttgccacagagactgtgtggcccaccagtctacaatatttactattttgcccctccccttaagaaaaagtttgctgactcctgcactagagtaagtcctactctaggaccctcttaacaacaaactgtgcgctagctaaggtctgtaagcaaatcctgatgaaatctgcggagaaagcagaacttggaggctgagttctgccaggttacaggacttgggaaacatcctgggctttccatagatctgtcctaacaaaagtattactggagttaaaattagaatgttttggggcagtattaccttctttggtgctttttgtaaccttcgttatagtgacagtgactttagccagcaccctcgaatactttgaatgtcttgtttactcccctagataattctatgttggaatatgtctcattccacttaaaaaa

SEQ ID NO: 54232 - DNA, 1131 bp, Homo sapiens
gaattatcatgtaactgagtacatcacttcttagtcctcactacaggaccaaattcagttaagcagaggcctgtattctgctgataagccaggtattcccgggcagagcaaggcagtcaggaaaatgtagcaggatctcctgaaccacggatgctaggatcacacagtaaaatgcttcagaaagaggggtgcagagagcaacaggaatgctctccaatggcctgcagcaggttttgagaagaaaacatgacagggaacaggggtgtccgccctgctctgggcaacacccgctctcctactcatctgcagcccctggtggctaggtccatccaaggcactggcaggtgagctcagcttggggagatagttacgaaactgacatgtgcgtggaactaggcgaggcgccttactatttatttacagacttcataagcatctattctaaaattactcactaccaattttacaaggcaaaactctatactgtcctcacagctttagtgaaaacaactttaaaaggggaaaaatgaaaactagaccacaaagggttggaaaaatcttgcagaaccagctctaccacttaaggttgtttgccgctctgtaatccacatcgagctaattgtaagatttccctgtaaattcagactcttgaggttttcacaagaaataatctgagaagagtccctagcttccctcatccattaatttctagacaagagttttacaaaaggcagaaaagaaacagccttgactggagtatcgcagatcctaaggaaagaatgccctgctttgagcctggagataaatagcaccaccccctctttaaaactaaacattagggaatgtctcatgcctgtaatcccggcacttaagaggccaaggcgggtgaattgcctgagtgacagagctcgaaaccagactgagcaacatggtgaaacaccgtctccacaaaacaacaacaacaacaaaatacaaaaattagcccggtgtggtgggtgcaagagcctgtagtcctagatactcaggagtctgaggcgggaggattgcttatgcccagaaggttgaggctgcagtgagccaggatggtgccactgtacaacggtctgggtgacaaagggagatgctgtcttt

SEQ ID NO: 54233 - DNA, 448 bp, Homo sapiens
ctgtcttcaaacagcgttccttaatgctagtttgcacctgtccatgaatgcagtggcagtgccaagataactttcttgaaggaatgcttttgcaattagacctcgtgtgcctgtcttcatgcaggaacccccagttaaaagatatgagaggattaataattggggtgccggcacagagactcaggcctgtgatcccaccactttgggaggcctaggcgggcagatcacttgaggtcaggaattcaagaccagcctggccaacatggtgaaactctatctctaccaaaaaatacaaaaattagccggacatggtggtgtatgcctgtaatcccagctactcgggaggctgaggttaaggaatcacttgaacccaagaggcagaggttgcagtgagatgagattgtgccattgcacttcagcctgggcaatagcatgagtctcagaagag

SEQ ID NO: 54234 - DNA, 479 bp, Homo sapiens
gcactattcaagcatctctcagataagagttcctggcatgatacattatcctattttaccttctgaacagggttgtgttgaggataaaatagcaagatgacatgtaaaagcacatagaaggttttcatgagtaaaaattaatatgactgctaagtacttgactttatattactagtcccttttaaaatgtattttttaaacatggacaaaattgccacataatatgtaatataaattatctgggaaaaatttgctaaccctcttattttggccaaatgtctcccccagatggatgtggaactaagactcagatccaatattggctgtgccaaatgaagaaatggaaatagatttgaaaggtgggaactttgaatggaaaactttttttccttgctttccaacctagaatctgttcaaaagtgttagacagctctcagaatgcacagtgggagaataaaatttcaaatggaaaattttaa

SEQ ID NO: 54235 - DNA, 389 bp, Homo sapiens
gcactattcaagcatctctcagataagagttcctggcatgatacattatcctattttaccttctgaacagggttgtgttgaggataaaatagcaagatgacatgtaaaagcacatagaaggttttcatgagtaaaaattaatatgactgctaagtacttgactttatattactagtcccttttaaaatgtattttttaaacatggacaaaattgccacataatatgtaatataaattatctgggaaataagactcagatccaatattggctgtgccaaatgaagaaatggaaatagatttgaaagggtttccctctgtcacccaggctggagtgcagcagcactattgtggctcactgcagcgtcaaccttctgggctccagcgatcct

SEQ ID NO: 54236 - DNA, 338 bp, Homo sapiens
cactgccagatgtgtgaatgtatgtcttcaagtttcattttctggaatatgcttactgtagtttatttcttatccacttttgaagtgattctcattccatgggtaatagatttagtggcattaaatgttcagaacatccaaaaattaataaaatatatatttggactccgtctcacaatccaaaacagaaatcagaaactgatctaaagtgtatgttaggtaacaatgttctgtagcccgagttgcagaggagctgtgtggggcacttcactgtgcatctcataccacacttgcccagagcaccggcaatgtgaaggaaagagagagaataaaggaaa

SEQ ID NO: 54237 - DNA, 336 bp, Homo sapiens
gagagagatggaacagctggttggtggagcaatcagaacaaacatacatttattgattcaatttacagtcttatgtggggtggttcagtcatcccaaagcaattaccatagtaacatcaaagatcacgatcaccaaaacagatataatgaaaaagtttaaaatattgcaagaattaccaaaatgtgacacagacatgaagtgagcacatgctattgggaaaatggtactgacagacttgcttgactcagtgttgccacaaaccttcaatttgtagagtgcagtatctgcaaaggcaataaagtgatacacaataaaacaagctgtgtatgtatttt

SEQ ID NO: 54238 - DNA, 2831 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54239 - DNA, 2905 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54240 - DNA, 235 bp, Homo sapiens
gcggccgcctactactactactactgctcgaattcaagcttctaacgatgtacggggacatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54241 - DNA, 2773 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgatcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54242 - DNA, 2999 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaagtagagacggggtttcaccatgttagccaggatggtctcgatctcctgacttcgtgatccgcctgcctcggcctcccaaagtgctgggattacaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54243 - DNA, 2983 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggcaaatggatccattcgctgtcttcatcatgagtctgggctgcttatcaattctggaaaaacgtattcttttgctaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54244 - DNA, 1997 bp, Homo sapiens
gaagttcctcaggaaactagctatttaaaaaatttgaggggactggataagaaaaagtagggaaattaaaatttgaatatttggttattcttttatgtgtctgcataggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54245 - DNA, 620 bp, Homo sapiens
  misc_feature (27)..(27): n is a, c, g, or t
agtagtaatttattctgattgcatatnatttaataattcccatgctagttttgcttttagaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54246 - DNA, 1072 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctgggagattttctctctgttgcccaggctgagtgcagtggcatgatcacagctcactgca

SEQ ID NO: 54247 - DNA, 274 bp, Homo sapiens
gagaactatttgagcaagctgtggtgagtcagttaatgactaatgccaggtggtcagacgctaccagcttatattaaagatcctgctttttctgatgctagtatttgttaacccactcactggccattcttttattaatataaacatggtaatttgctatgcatgatggctaaatatttaaagtagatttagtgataccagctgttggataaataacccttttcatttgaaatcaaacataaatgtaattggtgagaaattctgggccgtcata

SEQ ID NO: 54248 - DNA, 484 bp, Homo sapiens
taaaactagtttatgtcacataaaactgtttagtatcatttgacccaaaccacaaagttgaactgttggtattttatttcctttctgtgtatgtttagtatgttggtgagagtgaacgtgctgtgcgacaagtttttcaacgagccaagaactcagcaccctgtgtgatattctttgatgaagtggatgctttatgtcctcgaagatcagaccgagaggtaagtatcatggactagtggttttcagattcttttagcacaataaaccttttctatgttccaagccaggtatttcttatgaagtcatcccttgggagcattgagactcttaatgaagacacttagtaatttgaaatcaaatcctagagatagcagttgtattctgtatccgcctctgcatccagtttttttcctgtacattattttggttgcacaatctttaggtcatcctaattcacacaaatgagtaggtaagtatggaaatg

SEQ ID NO: 54249 - DNA, 2558 bp, Homo sapiens
  misc_feature (1)..(1): n is a, c, g, or t
ngcccccggttgactaggagctggcggtccgagctgtggcttgaaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54250 - DNA, 3178 bp, Homo sapiens
  misc_feature (1)..(1): n is a, c, g, or t
  misc_feature (2907)..(2907): n is a, c, g, or t
ngcccccggttgactaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaaanaaaaaaaaaaagaaaaaataattgtgggggcgcgcgaccaaggaaagtttaaaccaatccgtgggcggcgccagtggtgcatgaaattggcaaacgttgcccaggaacggggcatgtcatgggggttccaccataaaacgcgggccgggtcggacaacagagggtcgcgcccgtccacgggcagcgatcccccgcgccgggaaaacaacacagcggagcaatcaaacagcaaacacagccgcgaaacggagcaaacacgagaagcgtgatg

SEQ ID NO: 54251 - DNA, 1134 bp, Homo sapiens
atacgctaggtacgaggctgggtgtgcggatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaa

SEQ ID NO: 54252 - DNA, 390 bp, Homo sapiens
gcaaactcaaatctcaaagagccatgtgtttgaaggactctgtgaaagaacagttggactgtccagagaaaatataagtgcaagctgcaaagcccagactgggaaaggtccagctaatcaagagcagcattctggggactcagagataaaactgaccactgagggtaccctatgcttccccagcccacggctgcgcaagccaaggagagccaggtagactgcgagaggagtaagaggcaacatcccacacagagaggaagaagcaccagccagtggctgttgtgaggcggcttctgcagctgctggaaaaggctctgctgagagggctcagcttgactggccttgccttggaaacaaagagcgaagggtgaaagagaagcttaaagtcca

SEQ ID NO: 54253 - DNA, 2181 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54254 - DNA, 2136 bp, Homo sapiens
tgagctcgtacctgtgaccatgtgttaaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54255 - DNA, 2542 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaggcggatgctggggtgaagcagccgcatgctaaggaacaccaaggactgccaggagccgccagcaactggggagagacgaagaaggattcttccctagagccttcagagagaccatggccctgctgacgtcttgatttcaaacttccggcctccagagctgaaagagtacatttctgttgttttaagccacctagtttgtggcaatttgttacagtatcagtatttgaaatcgcaaaaaaatcaacaaaaacaacaagaaaaaataatgtggcatgttagtttcccattgctaatgtaacaaattaccaccaacctaatggcttaaaacaacacaaatttgtcatcttagagttattaagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54256 - DNA, 1821 bp, Homo sapiens
  misc_feature (1660)..(1660): n is a, c, g, or t
  misc_feature (1666)..(1666): n is a, c, g, or t
  misc_feature (1668)..(1668): n is a, c, g, or t
  misc_feature (1670)..(1670): n is a, c, g, or t
  misc_feature (1678)..(1678): n is a, c, g, or t
  misc_feature (1682)..(1682): n is a, c, g, or t
  misc_feature (1685)..(1685): n is a, c, g, or t
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaatgatgcatgtacngaagananantgtgaacntganaanagtcaacgtgggtttttcacaaaattgagggggagaggagaaggtgcgggtggtttggaaaacaacgtaaatgttcagggcgggaaaaaatgttgggcaatttgcggaagaagaaacttttggtgtgaaaagaata

SEQ ID NO: 54257 - DNA, 2122 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttggctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54258 - DNA, 1131 bp, Homo sapiens
gcggatttgaggtcttaaaaagctttggattttgtctccagaggatttatttaatgtggatgcttttaagctggaatcattagaagcaaaaaacagagcattgaatgaacagattgcaagattggaacaagaaagagaaaaagaaccgaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54259 - DNA, 1007 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatgaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54260 - DNA, 930 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaaggtatttgatttgttcttttgaaatgtatacatgggaaagggtttttttcctcaaaaaaaatattttctctcccagtcttttgacagtattctcaaagtctgcttcagagttttcatttttcaaagcacatttgattttaagtttttcaaactattatcacaaggtaaa

SEQ ID NO: 54261 - DNA, 812 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagttgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54262 - DNA, 519 bp, Homo sapiens
ggtatgtatatttcttattagtttagagacatgactggcacacagagatgaaacaaattaaatcaatttgtaaaaagtttgagttacagaaataatatgttttaagatgaccactgtgggcaatatatgtaggataaattgaagagaaaaaaagcaactgcttacaaaaaaacaaataaaaattgctagtggtagaagcaagaaggattaacaaattgttagtaactgatcaagtttgatgatgggtacagacggataaaatccacttttctttgtttaaaaaaaaactactcgtagattattacagagcaacagaagacagaatataaagccctgaactgctgaagtgacagagaatagaaaagacagactggataccacagattttacagaagccaaaaacaaaaaaaaacaggattcacgcctggtgaaaacagagtgtgatgaaattgaaagtgggaagaatggatttggaggtgtacatacctgtcatttattgggggtatattgaatttgagg

SEQ ID NO: 54263 - DNA, 916 bp, Homo sapiens
  misc_feature (755)..(755): n is a, c, g, or t
  misc_feature (761)..(761): n is a, c, g, or t
  misc_feature (763)..(763): n is a, c, g, or t
  misc_feature (765)..(765): n is a, c, g, or t
  misc_feature (773)..(773): n is a, c, g, or t
  misc_feature (777)..(777): n is a, c, g, or t
  misc_feature (780)..(780): n is a, c, g, or t
gcggatttgaggtcttaaaaagctttggattttgtctccagaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaatgatgcatgtacngaagananantgtgaacntganaanagtcaacgtgggtttttcacaaaattgagggggagaggagaaggtgcgggtggtttggaaaacaacgtaaatgttcagggcgggaaaaaatgttgggcaatttgcggaagaagaaacttttggtgtgaaaagaata

SEQ ID NO: 54264 - DNA, 2170 bp, Homo sapiens
ctagtacgagctgggtttaaatcggcaccgaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54265 - DNA, 1767 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggtaagaactttgccacagtttgcgtag

SEQ ID NO: 54266 - DNA, 1053 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccg

SEQ ID NO: 54267 - DNA, 1812 bp, Homo sapiens
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcggtatgtcataccatttccagagtggcaactcatcatagctgacctttctgaaggtctgtcccaattaagaagaagtcagtgggtagagtaaattggcttaagaggtaaaacattagcattgacattttaatgaaacactcatccctttatgtcaattcagtaacatcccaatttctctcaaatttaagataagttatatttcataacccaatgaaaaagtaaacaaaaaagtctctaaaactatgaaaataatgttcataggtcccactccttttactctgtagaagaggaaatgagtccttcattcacctattcactacttaagcattaagattgaacatccgctgtgtgtcacttatgctaggcatagaggaaataaagataaaacattggctttcccctcaaaaa

SEQ ID NO: 54268 - DNA, 765 bp, Homo sapiens
cggacgcgtgggtcgacccacgcgtcaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaatc

SEQ ID NO: 54269 - DNA, 791 bp, Homo sapiens
  misc_feature (663)..(663): n is a, c, g, or t
  misc_feature (699)..(699): n is a, c, g, or t
  misc_feature (769)..(769): n is a, c, g, or t
tactgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggaangaaccttttggggtattcctttttttgcacctactnccaaaaaagctcccattgtaccacaagttgggggggctccctcaatacaatggtccttcacattttgtgngcacgcctttaagttttgggct

SEQ ID NO: 54270 - DNA, 391 bp, Homo sapiens
ctagtacgagctgggtttaaatcggcaccgaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaagagaaaccacctttggaagttagtatatacaaccgacatcttaagagaaggtctctatttgcaaagaccttgggcatggcccggatgtcacttgatatttccgtcttgaatcagg

SEQ ID NO: 54271 - DNA, 286 bp, Homo sapiens
gtccagagcccatttgagagcagtggatgacaggacaggtctatgtgacccaggcaggcagcaatattgggtcagccttcatgtccccttctgtcagctggggcagcctggaaggatgattgtggggtaggtgttatgggcacggaatagacctcaggtggaggctgcaggggctctccggcaccgtagacacagcaggcccaggagcaggggagggagccatgactcagggagactctggcccatatccttggcagatgagggccacaggggaatgggcagcact

SEQ ID NO: 54272 - DNA, 342 bp, Homo sapiens
cattcctattgaaagcctgtgagcatggctttcatggagttgggaaagcacagggtactgtgcccaggaaacgtggagtttgatactggagagttagagtttaacaaaatggattgtgtcatagagggccatggataccaggaagaggaatttgacctttatcctgtaagcactgggtaacattgaaggtatttgaataggagggtgcggggagtagggttatgcttctagacctgacagcattgtgaaggattggatgcagggaacccaatagttcagggcatgcaaccccagatgatacggggcctgcttgatcaaagccatgataggagggagcagaag

SEQ ID NO: 54273 - DNA, 344 bp, Homo sapiens
cctcacatttctgtttttgcttttatattgtccaagctgaataacatatatatttggttacataatcataattaacatcctctgttcagttttaacagtgttactctaaagttgaaaatcacataagtgcttccattatcgtgaacacagtgggatgtgcaaagaaaatgaaacggcttgttctttgtgactggtgtgatattaatgatgagccccgaccctcctatgtgcctgggagaacattgccttgatcaccaatcctatgtcgtcatgtcctgggcccccaagaccacctcccccctccagattcagtgattcaccaggagagcctgcaggacttgctg

SEQ ID NO: 54274 - DNA, 3590 bp, Homo sapiens
gggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacctataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatc

SEQ ID NO: 54275 - DNA, 1009 bp, Homo sapiens
gggaatcttatactcggtgctttgctcaagatcagtgccttgactttgtacattgctaatgcacacacaaaacctttgggtatcatgaaatttttgatgacattattgaatatttgaatattgctgggtgttttttgttttgtttttggtgactcagcgtataaacctgctttctttgggggacaaaagaaaggtatggaacttaaaacgcagcatgtattttctgctactgaatccaaagatcgtagatgctactgagggagcatgtgactaatgactaaggcttggccagccattagctcttgcctgattaaactccacagactttggaatctagcaatattgtcagcatcgtgtgtccattattagaattgttggtggtgactttctgggcaaattatttcttttgaccagtctcccttggttcttaccttttatgcaatcctggttctccactactgattctgtaaactaatccaatatttttaatgaaatccgcttccttagttagctaaattcagtttcgattctttctaagaatcctgattgctacagttaggaaatcagctatcatatgagttttaaaataaggggaggtatgctatgaattattggtaagtagggtcctgctttgaaagtgatgagagagactctgtactttaataggttaaaacttatttgtaattatgttgctgtggaatataagcagtttttttcatctcacccaatacagctactaggctttatagatgtatgacagagttaccatgtgcaatagagtttggggtgataccaacaccattgaattaatcagtgttttgatagaagggtgatcatctgaattccaaatttgaggaatacaatagttttcagttaaatatgaatctttagattggcatctagagccattaaatttcctttgtaaactaaagcatgatgagtaaaaaattaccaattaccttatgtatactaaatactgtactagtctctgtattatgccaggaataaa

SEQ ID NO: 54276 - DNA, 389 bp, Homo sapiens
attattatttcactgaggtttacacctcttttaaaattaattttcatatttccctcaggatttgatttactatgaaacaacacgaagccaggtgggttgaagtttattaggaaaaaatggaagcttggggaatctgaggaatattttcaaagtacagaaaacagcagtactgtgaaagtctttatagagcagaaatgatttaggacggggcctccaaaaaggggaactttgcatagcatagaagttgtgactttttctttacctggtggtctcattacaattcttaaaggctgataacctttacttaaatacattttttgcaatgacacatttatgcatatatgcagcaggtgagcagagggcatagtcagggctttcattactaaaat

SEQ ID NO: 54277 - DNA, 474 bp, Homo sapiens
aaatatttcatgatgcactatttatataattaatacattctagaaaatagttctgttcttaactcccagctaaatgagaaaacaataaacttaccaagggccctttgagaaagttatagaaagcatattacacatattgtatacactggctctaacagattacttttagctacataaattataattttaactttaatgatttgcatctttagctaaggcagcagatatgtgaggaaaaaactgtttacacatgttgatgagagggataaaaatacttgatctatcacaaggtcaggagatcgagaccatcctggctaacacgatgaaaccccatctctactaaacatacaaaaaaattagctgggcgtggtggcaggcacctgtagtagcagctactcgggaggctgaggcagaagaatggcacgaacccgggaggccgagtttgcagtgagccgagatcgcaccattgcactc

SEQ ID NO: 54278 - DNA, 307 bp, Homo sapiens
gcatgtggatgggagatatggttgccaccatctttggaaaacagaattttctacaacatcctctatgcaatcacttatacatactgtatcttgcaataaagcctttgataagaattgacagaccttgatccttaaagggtatctttttggtgtcaaacactagatgaatagtctaaataggtatacagcacacttgagagccactgtgactgtaaactaaatggctcaacagaatctgggtcctcaaatatattagcatgctcaggctgccatcacaaaataccacaggctaggtggcttaaacaac

SEQ ID NO: 54279 - DNA, 232 bp, Homo sapiens
acaaaactacagaccaggacccctcttgaacatagatgcacaaattctaaaaaatttagcaaattatatttaacaatatatataaattcatcatgaccaggtgatgtttactccaggaatataagtttcatttaacattcaaaaattaatgtattattaccatattagcaggccaaaaaagctaaaactgtatgatctcaatagatggagaaaagatatttgccgaagtcca

SEQ ID NO: 54280 - DNA, 1145 bp, Homo sapiens
  misc_feature (33)..(33): n is a, c, g, or t
  misc_feature (1114)..(1116): n is a, c, g, or t
  misc_feature (1121)..(1123): n is a, c, g, or t
  misc_feature (1130)..(1131): n is a, c, g, or t
  misc_feature (1133)..(1133): n is a, c, g, or t
  misc_feature (1138)..(1140): n is a, c, g, or t
  misc_feature (1142)..(1142): n is a, c, g, or t
  misc_feature (1144)..(1144): n is a, c, g, or t
cggcagtgaggctgagtattttcggtcacaggncaggcccgtgaaatttcattgtcctgctctgggcccaaaggtggtggtggtttgggtcatcagaggactgcctgggacggttcagcgggcacggtgcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattnnncaaannnaataaannantagannntnang

SEQ ID NO: 54281 - DNA, 3602 bp, Homo sapiens
  misc_feature (3571)..(3573): n is a, c, g, or t
  misc_feature (3578)..(3580): n is a, c, g, or t
  misc_feature (3587)..(3588): n is a, c, g, or t
  misc_feature (3590)..(3590): n is a, c, g, or t
  misc_feature (3595)..(3597): n is a, c, g, or t
  misc_feature (3599)..(3599): n is a, c, g, or t
  misc_feature (3601)..(3601): n is a, c, g, or t
atcagtctgtggatgatagtcccaataaaaccatattgtaaaaatttgccctaatccgaatttcagtgtattttgaaactattagatatttcaggctatgtcaaagatcctagattatttaatacagacatccaatcctaatttctgtttcttttcctttaggtaaatcattttattttcacttgattacctgagtatagcttccaaaaataactaagacatatattcacataactaaaaaatgatctctcatttatttatggcacatattaaaaatatataggataggttaaaaaagtagataactgtataaagaactcatctgtgaaacatgagaataaaaaaataggttaataacaatgctgtataaagttattcttttctgtttttcagaatccatctgagaatatgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattnnncaaannnaataaannantagannntnang

SEQ ID NO: 54282 - DNA, 2085 bp, Homo sapiens
  misc_feature (2054)..(2056): n is a, c, g, or t
  misc_feature (2061)..(2063): n is a, c, g, or t
  misc_feature (2070)..(2071): n is a, c, g, or t
  misc_feature (2073)..(2073): n is a, c, g, or t
  misc_feature (2078)..(2080): n is a, c, g, or t
  misc_feature (2082)..(2082): n is a, c, g, or t
  misc_feature (2084)..(2084): n is a, c, g, or t
gctcatctgggcagaggaagcttcagaaagctgccaaggcaccatctccaggaactcccagcacgcagaatccatctgagaatatgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattnnncaaannnaataaannantagannntnang

SEQ ID NO: 54283 - DNA, 3277 bp, Homo sapiens
  misc_feature (3246)..(3248): n is a, c, g, or t
  misc_feature (3253)..(3255): n is a, c, g, or t
  misc_feature (3262)..(3263): n is a, c, g, or t
  misc_feature (3265)..(3265): n is a, c, g, or t
  misc_feature (3270)..(3272): n is a, c, g, or t
  misc_feature (3274)..(3274): n is a, c, g, or t
  misc_feature (3276)..(3276): n is a, c, g, or t
gctcatctgggcagaggaagcttcagaaagctgccaaggcaccatctccaggaactcccagcacgcagaatccatctgagaatatgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattnnncaaannnaataaannantagannntnang

SEQ ID NO: 54284 - DNA, 3348 bp, Homo sapiens
  misc_feature (3317)..(3319): n is a, c, g, or t
  misc_feature (3324)..(3326): n is a, c, g, or t
  misc_feature (3333)..(3334): n is a, c, g, or t
  misc_feature (3336)..(3336): n is a, c, g, or t
  misc_feature (3341)..(3343): n is a, c, g, or t
  misc_feature (3345)..(3345): n is a, c, g, or t
  misc_feature (3347)..(3347): n is a, c, g, or t
ggactgtttttacccctcctgggatcaccactgacagcatccatgaagttctgacagaagaacacaccaggatgacaaagtagtgacttttaaagagcagccaacaacaagcatatagggaatctctcagcaaatacagaatccatctgagaatatgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattnnncaaannnaataaannantagannntnang

SEQ ID NO: 54285 - DNA, 961 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaatgcccagctgctctcatttc

SEQ ID NO: 54286 - DNA, 935 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54287 - DNA, 982 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttcgagtatttaaataactttaacttcacccacaatctgggggcctaataacttagattccctcgggcttcaattcacgtcactactcactgtcggttcggaaaaaaagggggcaaccgggcccgccccttaagccaagggtaaaaggggcagaagggtatcgtgcccaaattttcggtttctgtgcgt

SEQ ID NO: 54288 - DNA, 535 bp, Homo sapiens
tcggtaccctgtcgttctcgcctcaacctcaccagccatttctatcttgtataagccacgtctctctccccgcctgagagaatgcttgaattgttggcactctgttctttgctacccaatggcttggaaaaatagcatgaacgtcaccatctctctgagcagcaggggagaaagacggctctgttcaaaaaagaatgggtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcaggtatgttttaaaataattaagctattatgttgttacaatgcttaaagtttctaccacatgtactccagccgtacattctctttgactcccaacaataaaatgttctttgggctgcatccttaaa

SEQ ID NO: 54289 - DNA, 909 bp, Homo sapiens
tgcctgcagccggcgggtacctgcggccaattcggtggaacgaggacgcggactgcgaaggcaggtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54290 - DNA, 1104 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagggtgcacattttcaactgctaagtcttgtgactgggtaaacaagccaggggaggagtgccttgtgcttgagagctggctcaggcatggaggccctgtctcggagcagactcttcctctcatgatgtggtccctctgtgatttggtacaacttaaggatctgtgaggaagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54291 - DNA, 710 bp, Homo sapiens
  misc_feature (24)..(24): n is a, c, g, or t
  misc_feature (71)..(71): n is a, c, g, or t
ccccccccccccatcaaccccccnctcccccccctcctcgtaaaagaaaaaaaaaaaaagagctacatggnaaacgcgctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54292 - DNA, 699 bp, Homo sapiens
ccggcagtataaatgatctccgcgcaactcataagacagcatactaatttatagcccgcacgctctgctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54293 - DNA, 995 bp, Homo sapiens
  misc_feature (947)..(948): n is a, c, g, or t
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaacaaaaaacaacnncataagaccctagataaaatcaaataatgggcctcctctggcctaag

SEQ ID NO: 54294 - DNA, 867 bp, Homo sapiens
  misc_feature (842)..(842): n is a, c, g, or t
  misc_feature (852)..(852): n is a, c, g, or t
  misc_feature (855)..(855): n is a, c, g, or t
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaaaaaanaaaaaatggnctngttggcctcagt

SEQ ID NO: 54295 - DNA, 884 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagaccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaa

SEQ ID NO: 54296 - DNA, 597 bp, Homo sapiens
tgcctgcagccggcgggtacctgcggccaattcggtggaacgaggacgcggactgcgaaggcaggtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagatgagataactgaagcccaaagatgaaaagcagcttgcctgaggtcacacagctagtatgtaggggagctcagattcaaatcagggagcctgactacagaattggaatgcttatctcctcctgcttcacatattcatgagacatatgcaaaagccgagacatgctaatgtgagaatgtgagttagccttaagcaatttgctttatgaataactgtattataattgcacaataatgatacagtgaataggaagtgttagtagaagttttaagacacaattaaagataagttgtagaaataaagaatacattcctctgggac

SEQ ID NO: 54297 - DNA, 1577 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54298 - DNA, 1029 bp, Homo sapiens
cacgcgtcgcggactgcgtgggtcgacccacgcgtccgggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccagggtggagtttcctgaactatgcctgttttcctcccacctggaagagaggaaaggagagtggatccccttcactgtgggaattatagggtgcaggtgtcagaggacattgggctgggtgttaagagaactgggttctggtcctgatgcagcctctctgatttgctttgggacccaggcctgagcctcccatctctggcctcagctcctcagctttacaggaagggcccgaatggggaatctttatggtttgtctcatttgaggtcttgagacacgggcggggctgggtcactgtatttgtcctattttctttgcttctgcacattgaagtctgatcttggtcatatgcctctgctcaaaacacatatgagggcatc

SEQ ID NO: 54299 - DNA, 246 bp, Homo sapiens
atgtgggagccaagggcatagatgtgaggacctccctatggagaggaaaaggaggcagctggaatgcagacttgggactatctgtttacctgcctggtcacttaatttctctgagaggcattaacagttaaaatcctgagagggttattgccaacagcatggatggggttgctttctaggagcagggaataaaggtggtggtacccagagggattctttctcagccagggtctccttccctgtggg

SEQ ID NO: 54300 - DNA, 1658 bp, Homo sapiens
agttctctcaaaagaaaaaaaaaatcgtcggtttccttttcccatctttctttcgtgacttatattccagaacgaagccccacacatcattaatgatttgaatcgtttctaaagtgtttcttaaatcgtttcttaaatcgtttgttgtttcttgtctaacagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54301 - DNA, 1848 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacacccacaagaaggagagaggaaaaaaacacaagaggaaacaagggaggcacgccacacaaaaaagacg

SEQ ID NO: 54302 - DNA, 1728 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54303 - DNA, 1751 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54304 - DNA, 1205 bp, Homo sapiens
cacgcgtcgcggactgcgtgggtcgacccacgcgtccggtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54305 - DNA, 1827 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccagtgaggctcccctgccctgatggttgggggaggtgggctgggctcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54306 - DNA, 861 bp, Homo sapiens
tctgtccctccatttcccctagatgggagtatggggggatggaatgctcacacacttccaacctaggggacctctcccctcagctctgtccatttatgctgctaagcagctctcctgacaccctgatgctcagagaagaggcatacatctaagatgagaaagtttctgggagtggatcataaataagaaagcagtgtgcagggagggggtgaggatgcagagacgccagagggtaggtgcagggtgaggatacttttgtgatgcttcagccttcctctaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54307 - DNA, 956 bp, Homo sapiens
tctgtccctccatttcccctagatgggagtatggggggatggaatgctcacacacttccaacctaggggacctctcccctcagctctgtccatttatgctgctaagcagctctcctgacaccctgatgctcagagaagaggcatacatctaagatgagaaagtttctgggagtggatcataaataagaaagcagtgtgcagggagggggtgaggatgcagagacgccagagggtaggtgcagggtgaggatacttttgtgatgcttcagccttcctctaggtccgtgtttatgatccagcatccccccagcgccggccagtcctagagaccacctatggagagtacccactaacagccatgaccctcactccgggaggcaagtgagtgtttagaggggaaggggtgggagggtggggcttgagaagggctccaggaggttactgctgatcccacttgcctctggtctcatcctcagctcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54308 - DNA, 1754 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtaaggtgtcacctcacacctgccttctcctgggataaagcagcctcctggagaaatggcccccacggtttgacacaactgctcttctcaccattctgagttcagaggagcaagcgcttccccgtctgttccaaccctgtccctgagcccatgaccttcctctactgtattctagggtggagtttcctgaactatgcctgttttcctcccacctggaagagaggaaaggagagtggatccccttcactgtgggaattatagggtgcaggtgtcagaggacattgggctgggtgttaagagaactgggttctggtcctgatgcagcctctctgatttgctttgggacccaggcctgagcctcccatctctggcctcagctcctcagctttacaggaagggcccgaatggggaatctttatggtttgtctcatttgaggtcttgagacacgggcggggctgggtcactgtatttgtcctattttctttgcttctgcacattgaagtctgatcttggtcatatgcctctgctcaaaacacatatgagggcatc

SEQ ID NO: 54309 - DNA, 1073 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54310 - DNA, 386 bp, Homo sapiens
aaacttctttttgtggagatggggtctccttatgttgcccagtctggtcgctaagtcctgggctcaagcaatcctcctgccttggtctcccaaagtgctgagattacaggtgggagccaccgtgcccggcccccctgactcctaagctttcttcccactcaccaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54311 - DNA, 283 bp, Homo sapiens
tcacgctggggaagggaggattaaggactctggaacggactcttatctcctattctttacaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54312 - DNA, 448 bp, Homo sapiens
ggccacgcggggccatgggctgctgccaagacaaggactttgagatgtctgatgagcagtccaaggaggaagagtctgaggacggcagggaagatgagaccacagacacacaaagagggcccagggagtgtgagagggggcttcccgagggtaggggtgagctcagaggcctcgtcgtcccctcaggcgccgaagatatcgacttgaactccccggaccatccgaatcacaagtcgaacgaaagccttctgattaccgtgctgtggcggcgactatccacgttcggtcgtcggggctcctcgcggccaagcaagaggcaaccagaccagattcggaagcaggagagtccgatccgagaaggcaaccaggaggagccggagaagggatgaccccagacctgctctcagtccgccccaacctccagagaataaaatttctaacgtatacc

SEQ ID NO: 54313 - DNA, 1785 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54314 - DNA, 1887 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacacccaaaaaaaaaacaaaaggggcggccgccttattatatagaaagaaatagaaagaaacaaaaagagaagagaaaaagaaaaagagccagagaaaaaacaaaaggg

SEQ ID NO: 54315 - DNA, 2024 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgcgccgaagatatcgacttgaactccccggaccatccgaatcacaagtcgaacgaaagccttctgattaccgtgctgtggcggcgactatccacgttcggtcgtcggggctcctcgcggccaagcaagaggcaaccagaccagattcggaagcaggagagtccgatccgagaaggcaaccaggaggagccggagaagggatgaccccagacctgctctcagtccgccccaacctccagagaataaaatttctaacgtatacc

SEQ ID NO: 54316 - DNA, 1736 bp, Homo sapiens
agttctctcaaaagaaaaaaaaaatcgtcggtttccttttcccatctttctttcgtgacttatattccagaacgaagccccacacatcattaatgatttgaatcgtttctaaagtgtttcttaaatcgtttcttaaatcgtttgttgtttcttgtctaacagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggtgggtggcaggctcgggcgtcgggaagtgcaggggtgcactcgcgcccctggcgtgactgacgccttcgtctctcaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54317 - DNA, 1555 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatcccggaattcggctacattcagaggtcgggcagacacatgcaggacattgagtcggacattgttgagttggggctc

SEQ ID NO: 54318 - DNA, 1556 bp, Homo sapiens
tcaggcaagtcgatacagagcccgaaccagctagggagggttggcaggtgtgagaaagaacataggcgcaggctgtgcagatcctggggagagacttgcttggacttctcgggagggatattttaagcaagagactgacatttagtgcctgaaactcagagcaaggaacccaagaagttggtgtttgactttgaccaagccctaaattcagaccagccctagtaagcaactcaagattcagacagatcagtacagccagatgctagacatagctgtgaacagcaaaagcactctggaatatcacagagttgatttctagctgtggttgtaacatagctgagtggcaaattagtttctcagcgcttctatttcctcacttggtaaaccctcaccctgttgagaaagttgaattaacagattaggaagctggaagctgtcaagccctgcctagagcccagtgacctagaggcttccttctaaactggactgttagtagggaatctggttgatatgagtttggggcctagagaatacttttatacttttttttttctttaaacattagtcaactgtagtagtaaggaggagagaaagattagaacaaggagtttaagcacttaaaaaatcccaactctatcctttctctgcagcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54319 - DNA, 1579 bp, Homo sapiens
ggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccagggtggagtttcctgaactatgcctgttttcctcccacctggaagagaggaaaggagagtggatccccttcactgtgggaattatagggtgcaggtgtcagaggacattgggctgggtgttaagagaactgggttctggtcctgatgcagcctctctgatttgctttgggacccaggcctgagcctcccatctctggcctcagctcctcagctttacaggaagggcccgaatggggaatctttatggtttgtctcatttgaggtcttgagacacgggcggggctgggtcactgtatttgtcctattttctttgcttctgcacattgaagtctgatcttggtcatatgcctctgctcaaaacacatatgagggcatc

SEQ ID NO: 54320 - DNA, 978 bp, Homo sapiens
tctgtccctccatttcccctagatgggagtatggggggatggaatgctcacacacttccaacctaggggacctctcccctcagctctgtccatttatgctgctaagcagctctcctgacaccctgatgctcagagaagaggcatacatctaagatgagaaagtttctgggagtggatcataaataagaaagcagtgtgcagggagggggtgaggatgcagagacgccagagggtaggtgcagggtgaggatacttttgtgatgcttcagccttcctctaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtaagttgtctctcccacctccaactcatggtcttgtggaggccccgcctcctgtgccctccgttcatgtttctgtctcagcatgcctggctccttaaggtccctcatcttttgcaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 54321 - DNA, 480 bp, Homo sapiens
tgttgcagattaaatgttgaaatggaaagtgattggaacaggaaacaatgaatggttggttattggccagccagttatcacggatgcttccccccttctctagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtaagttgtctctcccacctccaactcatggtcttgtggaggccccgcctcctgtgccctccgttcatgtttctgtctcagcatgcctggctccttaaggtccctcatcttttgcaggtttatctcaagtctcaattgaactgcctcctcttgtcaggcagggacaactgggaggtgagcagttgggcccgggaatgtgggagccaagggcatagatgtgaggacctccct

SEQ ID NO: 54322 - DNA, 463 bp, Homo sapiens
tagctgatcgatcgagctggtaccccccgactagcccgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgggctagtcgggggtaccagctcgattgtatcatgtcac

SEQ ID NO: 54323 - DNA, 1634 bp, Homo sapiens
accagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacga

SEQ ID NO: 54324 - DNA, 1532 bp, Homo sapiens
catgtactatactgtaagcagtgtacgcgatccggataccaaactaatgctgaaatctctggttacgccctcctaaatctcattgcatattcaggaaggaaggggctgtcgaggagagaggtgggaggtgtcggtcacgagagggactgattactccaggatacttaatgtcaggcgcgaagtcacagtgtagctggacggggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacga

SEQ ID NO: 54325 - DNA, 826 bp, Homo sapiens
tagctgatcgatcgagctggtaccccccgactagcccgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacga

SEQ ID NO: 54326 - DNA, 1271 bp, Homo sapiens
accagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgggctagtcgggggtaccagctcgattgtatcatgtcac

SEQ ID NO: 54327 - DNA, 661 bp, Homo sapiens
  misc_feature (264)..(265): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (276)..(276): n is a, c, g, or t
  misc_feature (278)..(279): n is a, c, g, or t
  misc_feature (281)..(281): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (313)..(313): n is a, c, g, or t
  misc_feature (324)..(324): n is a, c, g, or t
  misc_feature (329)..(330): n is a, c, g, or t
  misc_feature (333)..(333): n is a, c, g, or t
  misc_feature (335)..(335): n is a, c, g, or t
  misc_feature (337)..(338): n is a, c, g, or t
  misc_feature (340)..(340): n is a, c, g, or t
  misc_feature (343)..(343): n is a, c, g, or t
  misc_feature (351)..(351): n is a, c, g, or t
  misc_feature (356)..(357): n is a, c, g, or t
  misc_feature (359)..(359): n is a, c, g, or t
  misc_feature (365)..(365): n is a, c, g, or t
  misc_feature (368)..(368): n is a, c, g, or t
  misc_feature (371)..(371): n is a, c, g, or t
  misc_feature (374)..(374): n is a, c, g, or t
  misc_feature (376)..(376): n is a, c, g, or t
  misc_feature (379)..(380): n is a, c, g, or t
  misc_feature (385)..(385): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (401)..(401): n is a, c, g, or t
  misc_feature (403)..(404): n is a, c, g, or t
  misc_feature (406)..(407): n is a, c, g, or t
  misc_feature (409)..(410): n is a, c, g, or t
  misc_feature (414)..(415): n is a, c, g, or t
  misc_feature (422)..(422): n is a, c, g, or t
  misc_feature (430)..(430): n is a, c, g, or t
  misc_feature (433)..(433): n is a, c, g, or t
  misc_feature (437)..(437): n is a, c, g, or t
  misc_feature (439)..(440): n is a, c, g, or t
  misc_feature (443)..(443): n is a, c, g, or t
  misc_feature (452)..(452): n is a, c, g, or t
  misc_feature (458)..(458): n is a, c, g, or t
  misc_feature (489)..(489): n is a, c, g, or t
  misc_feature (492)..(492): n is a, c, g, or t
  misc_feature (498)..(498): n is a, c, g, or t
  misc_feature (515)..(515): n is a, c, g, or t
  misc_feature (536)..(536): n is a, c, g, or t
  misc_feature (555)..(555): n is a, c, g, or t
  misc_feature (563)..(563): n is a, c, g, or t
  misc_feature (586)..(586): n is a, c, g, or t
  misc_feature (598)..(598): n is a, c, g, or t
  misc_feature (624)..(624): n is a, c, g, or t
ctcttccacaaaacatgcagttaaatatctgaggatattcagggacttggatttggtggcaggagatcaacataaaccaagacaaggaagaagtcaaagaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgaccatggggaggggnntnctgnttntncnntnctgntgactgnacgntggtgnccgtntcntgngaaccaccgcnagccnnttntncnntngcngatgccgntttanngntgggtntgnacncantntanngcccntncagccngancttantnngnngnnttcnngtgtgtntcatgccntcnagantnnacncataaattngttgtntgagccgggctctggtaggggccctgtagtngtntgatcntggtcggagtgttgctnaatggtcacgtatagccttgnggagtgtatgatattgggngctaatantggtgacacttcaaggatgcagntggcgctttctngagagatagtttttggctgtacgggngtgggagccttcacggtcgtgggatcattcgggcccc

SEQ ID NO: 54328 - DNA, 1505 bp, Homo sapiens
ctcttccacaaaacatgcagttaaatatctgaggatattcagggacttggatttggtggcaggagatcaacataaaccaagacaaggaagaagtcaaagaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacga

SEQ ID NO: 54329 - DNA, 1593 bp, Homo sapiens
ctcttccacaaaacatgcagttaaatatctgaggatattcagggacttggatttggtggcaggagatcaacataaaccaagacaaggaagaagtcaaagaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgaccatggtgagtgtagggtcttggggtcgaacgcgtgccactcgggagccacaggggttggatggggcctcctagacctctgctctctccccaggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacga

SEQ ID NO: 54330 - DNA, 364 bp, Homo sapiens
taattctgccctttaaaatgcatcatttaccctagaatctctgtcaccttaagtggtctgaatgatgtgtccctcactgttggcttcctcagttctctcagcattctgtgcgccgaagcctccttaggccccctgagaatatccagaggtgatgaggcccagcccctgtccctgagtttgccatctggctgggggagaggcaggcactcttagctctgatacctgcagactgatttgtcttaggagggttcgcagagttggtagagtctccaagaaagcgtggatcacctcctggcagagagagcagggcaggcttcaaagaggaggtagcctgtaatctcaccttgaaggatttcaatagatg

SEQ ID NO: 54331 - DNA, 133 bp, Homo sapiens
ctgggatggagtgcacacgagcaccagggagcaattcccagaagggctgccctgctaggagactgcacaggaatctcctaacagaggccacggtgcgcaggaatactggaagggatgcgagatttctatgggc

SEQ ID NO: 54332 - DNA, 279 bp, Homo sapiens
atgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcacgcagtgtgatccgtctcctttcagtcttctaaatagctgagtaatccattatttaaa

SEQ ID NO: 54333 - DNA, 251 bp, Homo sapiens
cactggattggaagggcaatccagtgggagaatgcccccgcctcaccaaagggctgcaggcttctccagggtaaggggaaagggcttctcttttagaaagaggcgtccacagagctgggaggaggtggcgtggggaagcggggacagtctgcaggacagagacgtcagagccaagcgtggttggccctggtgcgcctgttctcaggaaggcatctgctggctcgagtgagggcagccaaggttcggggctc

SEQ ID NO: 54334 - DNA, 406 bp, Homo sapiens
gcttggtgaatttttataaagtgcatatgcccatgtgaccactacagaagtcaaggtttggggtgttgcctgcaccctggaagcctctttcatgcctgtcatcttcattattccccaaagtaaccccaatgagacttctaccatcacagaatagtttttcctatttttaaacgtcatttaaatgaatcatgtggtttttactcttttgtctggtttcatttgctcagtgttatgtgcctgagattcattcatgcttttgcatatagcagtacttcattcttttccattgctatacagaattcctttgtatgatgatattacaatttatttatccattctactgctgttggacatttgagtatttctagctttttgttatcacaataaaggtgctatgaacatcctt

SEQ ID NO: 54335 - DNA, 403 bp, Homo sapiens
aatgaactgtggcaaagaataaaaggttctctgagaatagattattaattattataatgtctattgaaaaacttcgcaagtaaaaagagaaccaaattcacttttaaagattggtgtgcaggtggtggggaggggccgcacactccttcctcaccacgtttttttttttaaaggttggacatgcattgttgcaaggttttcaatgtgtgctatacacagaaaagtcaaaggttactcctttattcacaactgaatttccattcccaattcatattattgaaatgtgtaattctgactttctccatttgcatcgctttatttttaacactcttataagcaaactgttataaataccatgacaaattattttatgaacaatttatctcagtaacggtgacctctg

SEQ ID NO: 54336 - DNA, 2618 bp, Homo sapiens
gaattcctttttttttactaatgaaacactgcagattagtatccccaaacaattcattttctgacgaaactcttaaagcccagtttcagaacataagctttaagcaacaagcaatcttgtgttaatctgagctctgttacagctctgccgtaatctcagccaaattgcttcatctgtacgtggtgataccaccatctttgtaatattgtggtgaggattagagatgtatgtaaaagtgcatgcactgcctaatacccaagaattgctcaataaatgtcagctattactactcttactgacttccaactatgtgcagattatggtggaaacatgtgatacagcagatacagtacttaaatgaaaatgtcaaaattgtacaactaatttaagagtgggaaatgacagtaatgctaaattttcctaagaatatgtatgaaaaatagcacttccttgatggaacatacatttttagaacagaaaccttatgttataatggtaaaactagagagtcaaagtctctagttctaactctggctatgaccttatctagttgcatggcttttgacaagacaactgctcccctctggagttcagttttgtcatctggctggatttgagtaatctcaaataatctctaaagtcctttgcagctttaaattatctattgagtgtgataaagattacatcagcttgcttttcatcctgcacttcatttttggttcttgttgtttgcttaacttgcactttagagtcataagcaattcacacagacaacacaactaaagaactgataatatcagacttgcagggtaatccaaaatgaagtttcaacaaggaggataaaacaaaatagaatcacactgaactctttaatagggccaaagtaaaccccaatgtttattctccagtcatttcattaagttattatatggaaaatatgcctggtagaatcttatacattcactgaaatagtctccacagaaaataataggctcatagtgaaataaaataccactttcttttctctcatcaggttgatctttaaataaagcaaaaatttatccaaagaagggctttcatcaagaaattaaagagagaaattacaagccatagagaaactgggcatttctatactagagaaaccacctaaaacaactgtatggagtaagatgaaaggtactgaatatgcctggaagaaattttacctagtgtgacatttttgctcatctttttgtcacaaaaggctgctaaggaagagagaatacagttttctagagaataagagtgcagtgtaaaaatggaaaccacaatttcagaaattcatgtagaaaacaaggatgagaagagatcagcagaaggtagtcctggggctgaaaggcagaaggaaaaggcatccatgctttgcttcaagagaagaaagaaagcagccaaagcactgaagcccaaagctggctctgaagctgctgatgtggcaaggaagtgtccacaagaagcaggagcttctgatcagccagagcccacacggggggcctgggcctcactcaaacgtcttgtaacacgcaggaaaaggtcagagtcttcaaagcagcaaaagccattggagggtgaaatgcaacctgcaataaatgctgaggatgctgatctttctaagaaaaaggcaaaatctagacttaagattccctgcataaaattcccaagagggccaaaaaggagtaatcattccaaaattatagaagactcagactgcagcatcaaagtccaggaagaagctgaaattttggatatacaaacacagaccccattgaatgatcaggcaacaaaggctaagtcaacccaggatctaagtgaaggcatctcacagaaagatggtgatgaggtctgtgaatcaaatgtgagcaatagcataacttctggagagaaagtgatttcagtagaacttggattagataatgggcattctgctattcaaacgggaactctaatccttgaagaaattgaaacgatcaaggaaaaacaagatgttcaaccccagcaagcaagcccacttgaaacttcagaaacagaccatcagcagccagtactttctgatgttcctcctttacctgcaattccagatcaacaaattgtggaagaagccagtaacagtaccctagaaagtgcaccaaatggaaaagactatgaaagtacagagattgtagctgaagaaactaagccaaaagatactgaattgagccaagaatcagattttaaagaaaatgggatcactgaagagaaatccaaatcagaagaaagcaaaagaatggagccaattgctattattattacagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaaaggaattc

SEQ ID NO: 54337 - DNA, 309 bp, Homo sapiens
accatgttggccaggctggtctccaactcctgacctcgtgatccgcctgccttggcctcccaaagtgctgggattataggcatgagccaccacacctggccaactcctgcagttttaagtccatatgacctcaggagcaggtgacctcaggagcagacctcaggagccacctgggaggtggcttagaggctgctcccatcccacctgcaaaaatggtggggcctggacatggtctcaagcctcttccgtacccccagagctagaagtcctttaagccaggctctgcttctttatcgagtggccttgctg

SEQ ID NO: 54338 - DNA, 392 bp, Homo sapiens
tttcttttacttgtagtgttcattgatgtttaatgtaattcttgatttagctgggtttcctctatcattttatttttgttttctgcctgactcctctggtttttgttcatctgttcctccttccccatcttttaaaatgacttgaatactttttcttagaatgcatttagttttaatttttctgtcagcagtttagctattctttgcattatttttgacagtggttgtgctaggattccatcatacatccttaacttttcacagtccatttacagttaatcataggcccttcacataaagtatggacatctggcttcattatagccccagaaccacccccatcccttaataacagttgttgtaagtaatgcatctacatatgtcgtgagccc

SEQ ID NO: 54339 - DNA, 164 bp, Homo sapiens
gaatatttaaaatacttatggaaacaaatgatttttaagtgctgtcaggagcttgagaaacatccatttataaccaaacaattgagaagctcattaaaaatagtttttagccatttattacaaagcttctctaactacttttattgaaataccctttgaaattt

SEQ ID NO: 54340 - DNA, 334 bp, Homo sapiens
atttattataaggtactggtacacacaattatggaagatgagaagtcccatgatctgccatcttcaagctggagacccaggaaagctagtgttggtgtttgaaagcctgagaaccaatggtgtagatttcagtccaggtctgaaggcctgacaaccatgagtaccaatgacagaagactgatgtcctagctcagtcaggtagaaggaagatgattccaaattcctctgcttttttgttctattcagctatcaatggataggataatgccactcacactagggagggccatctgctttattcagtttaccaattcaaatgctaatctcttccgga

SEQ ID NO: 54341 - DNA, 198 bp, Homo sapiens
cttgcattcctcagcacattcccgttaagccattttcattttgttattggtactcgttagagtgtttctctgacattacccaagacatggatattttaggttttaggattatgttatgtccttcagtcataaagacagttgcagttaatgcccgggagcaaaccaataatcgtctctctaatgatgtgttctatactt

SEQ ID NO: 54342 - DNA, 365 bp, Homo sapiens
ctgttgaagggaatccagtgggagaatagagacattgtacaagtttttgaagttctgatccccaaattcctatgaatttttggtgttttgatccagaattggggtgcaatattttccactgctcgtgctttttctggagggctttaacttatatttctcaagcctgtcaaaaaccttagttattggggtgatttctggccagatggacctctctcatgggtatgacaggctgaactattggcccgagtcctgatttttggcagagtccagacctgtgccatgactgggataagtaggtaattagggattaattagggaagcagagaggtaggtgaagtagagtggtgagaaagtggttcactagc

SEQ ID NO: 54343 - DNA, 468 bp, Homo sapiens
gcaggggcagccgctcccagcctgatacctcatggcagccacacttgcacaaatctttaattgtttagtttaaagaattgtgttttgaccgcgaggggattttggctggagctcaagaagtgataatgatatttcgctgccaagacgtctccttggctctctgtgtgttaatgtgcactttcaagacgctccaattaactgcatcagctctcagggagagaaagggagagggagcgggcaggagagagaagggaaggagaacactggcgatgattgggaggaggcgatggagaggaaaagagacagcccacccccccaatctttttactagcaaacaaattgggggggatgggtgacaaagttttgaagatgagctccaagtgaagtggtgtctcatgctttggagggggagacattgatgagacagggaaaagtcttgaggtcaggtgccctggcccaataggaggc

SEQ ID NO: 54344 - DNA, 260 bp, Homo sapiens
  misc_feature (195)..(196): n is a, c, g, or t
tagcattagaagaaacacctaatgtcaatgacaggttgatgggtgcagcaaaccatcatggcacatgtatacctatgtaaaaaacctgtacgttctgcacatgtatcccagaacttaaagcataataataataaaaaagattttcctataaaataacttgactatgagggaatagaggtaaggaacggcccctgnngtatatgccaggtggggaccagaagtcgggaaggcacctaccacctgccctggctttcctcccc

SEQ ID NO: 54345 - DNA, 466 bp, Homo sapiens
tatctgggtacctgttcagttccgccagtcacaaatttggtctccaatttagtatagataatattgtttattgagtactattctctaccacagtctctgctaaacactttgtaaacattgttccatttaatactcaccaccctgataggtagtggtatatgcattttggaggagagagcactgagggttaataataactttcctcaagtcagctaactagtaagtgctcaaacctaggttttcataacttcagagtctgtgtgctcattcatgtagtagctgtgcagaaaaattaacttggctggactgtttgaagaaattagttcatatcagaaactgttttttctttgtttgttttgtctgtgactgggtcttgttctgttacccaggctggagtgtggtggcgtgatcatggctcactgcagcctcaatttcccaatccccttgtctcaggctcccaagtagt

SEQ ID NO: 54346 - DNA, 6741 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54347 - DNA, 3046 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatg

SEQ ID NO: 54348 - DNA, 2458 bp, Homo sapiens
  misc_feature (556)..(556): n is a, c, g, or t
  misc_feature (1907)..(1907): n is a, c, g, or t
aaaattatttaaatgtttaaaaatattgtttaaataaataacattcattgttgccaggtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccantaagtatccttcttatgctttcatgtatcagttatttaaagagaagtgaaaattttagatatttgttttatgctgaaaaaccgttttttatgctgaaaaaccgttttaaaccatagctatagtaaaatttagtgtttattagttgctggatgataatcaaagttatattacaatttaaaattttctatgtaggatacttgattctgccagtacatctgtctatacaaaactctggtctctccagaattttaaaataagcaaaatgtaactattaaaaaagtaggtgtagcttttgcttatagatactagaattagaaataaaaaccagtagagcatccaaaaatatatgtcccttagtacgtaaattttctttaataacctccactttaaaaatacctaaaagtttgattattacataattttagaatcatactcaaaataatccattgttcaaacctgcaatatattaaatctgttatcaaagttgaattgttgaagttcttttctttccaaaacaaaagtataccaggagaactcttggatgatctcattttatttctgcatctgttgagataagatttctggttttgatttgattttctgtgtttgttaaggctattttaatgaaaaaatacaatattgaatcaatatgtatgccaaattaattcatagtcctaatcctacttatagattaaaatttgagataaattgccagaaaccatcactttttaagaattgatcaggacttgtctctttaaattatctttcagaaaacaaattcttagagttaaagctaaactcttaaacagagaaggtgaattttagaagtatagtagaaagaacacatgtagattataatttttaataagttttggtcattgggtggttactaacccatgaatgtgacagtatttgtattcaactattatttgtaatagatacttgagtttttattttgtggcaagtagtatgttaaatcaatacaggcatttctactatagcacaaaatatgcactccttaaaaacctcacattctgcagtattacacaataaaaatgataggatgatgaggagtggagggaatagtcctggaacagaccactgaaaacccaagcaactttcttagaaagcattaataaaaacaataatgatactagcacagttaaattcatgttaaatctttattaaatactccaggagatatagaacttcatttttaaagaaagatttgaaggtaatgtgatggaaaggaaaggttgagactgttgaattaaggaaacatatgcagcatagacgaagatcagagagaatcatacagtaagatcatctaggacaaaatagccaaactganccaagaagtagtgatgttggagtaaatgggcattgtgtatattaatgtacaagttgattttaaaggaatttcaaaaaattactttttagctaggatagatttgagcgtgtagtcaaaacggttttaaataaatgattacagttatttttatgatcttatgaacgctcagtattcatcccatgtgtttcacagctcacatcagtcccgtatatgagctctgagacacaaagggtgcatattcactggggtccttgtagggacacaagggatgcttattcactcagatccttgtaggtacacaatggatgcatattgtctcagatccttgtggcatattactatcagtggttgaagtggtagctgtgttatattctttcattttctcaaggctatgaagaagtgatacaaacgagtttgttgactgttcacttataacttgtttattaagcagttaaaaatttgaagatatttaacccttttttcattttcatctttttttttcttttttttttgattgagtcagggtttcactccagtctattgaaagaaaa

SEQ ID NO: 54349 - DNA, 6682 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54350 - DNA, 6683 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54351 - DNA, 6653 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54352 - DNA, 4532 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatggga

SEQ ID NO: 54353 - DNA, 4868 bp, Homo sapiens
cgattcgagctcggacccctccatatgtggcccacattagttgctactgtgagacagaatcctgcagtgccttttctcttctggtattatggattccaagctggcctatttaaaatactgttgtcaaagacagttgtaatcctctaagtacttggtcatttagaactcacagttactttttttcttttagtagcccaggaatagcttttattgtttgcattgctgtgaagtttcctgaatacacatgtactagtgcccaatcatcagttgtaatttaaagcaatggtttcatatatacagatttccactcaaaaattggtttttctttgccatcccacagtaccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54354 - DNA, 4116 bp, Homo sapiens
  misc_feature (2214)..(2214): n is a, c, g, or t
  misc_feature (3565)..(3565): n is a, c, g, or t
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccantaagtatccttcttatgctttcatgtatcagttatttaaagagaagtgaaaattttagatatttgttttatgctgaaaaaccgttttttatgctgaaaaaccgttttaaaccatagctatagtaaaatttagtgtttattagttgctggatgataatcaaagttatattacaatttaaaattttctatgtaggatacttgattctgccagtacatctgtctatacaaaactctggtctctccagaattttaaaataagcaaaatgtaactattaaaaaagtaggtgtagcttttgcttatagatactagaattagaaataaaaaccagtagagcatccaaaaatatatgtcccttagtacgtaaattttctttaataacctccactttaaaaatacctaaaagtttgattattacataattttagaatcatactcaaaataatccattgttcaaacctgcaatatattaaatctgttatcaaagttgaattgttgaagttcttttctttccaaaacaaaagtataccaggagaactcttggatgatctcattttatttctgcatctgttgagataagatttctggttttgatttgattttctgtgtttgttaaggctattttaatgaaaaaatacaatattgaatcaatatgtatgccaaattaattcatagtcctaatcctacttatagattaaaatttgagataaattgccagaaaccatcactttttaagaattgatcaggacttgtctctttaaattatctttcagaaaacaaattcttagagttaaagctaaactcttaaacagagaaggtgaattttagaagtatagtagaaagaacacatgtagattataatttttaataagttttggtcattgggtggttactaacccatgaatgtgacagtatttgtattcaactattatttgtaatagatacttgagtttttattttgtggcaagtagtatgttaaatcaatacaggcatttctactatagcacaaaatatgcactccttaaaaacctcacattctgcagtattacacaataaaaatgataggatgatgaggagtggagggaatagtcctggaacagaccactgaaaacccaagcaactttcttagaaagcattaataaaaacaataatgatactagcacagttaaattcatgttaaatctttattaaatactccaggagatatagaacttcatttttaaagaaagatttgaaggtaatgtgatggaaaggaaaggttgagactgttgaattaaggaaacatatgcagcatagacgaagatcagagagaatcatacagtaagatcatctaggacaaaatagccaaactganccaagaagtagtgatgttggagtaaatgggcattgtgtatattaatgtacaagttgattttaaaggaatttcaaaaaattactttttagctaggatagatttgagcgtgtagtcaaaacggttttaaataaatgattacagttatttttatgatcttatgaacgctcagtattcatcccatgtgtttcacagctcacatcagtcccgtatatgagctctgagacacaaagggtgcatattcactggggtccttgtagggacacaagggatgcttattcactcagatccttgtaggtacacaatggatgcatattgtctcagatccttgtggcatattactatcagtggttgaagtggtagctgtgttatattctttcattttctcaaggctatgaagaagtgatacaaacgagtttgttgactgttcacttataacttgtttattaagcagttaaaaatttgaagatatttaacccttttttcattttcatctttttttttcttttttttttgattgagtcagggtttcactccagtctattgaaagaaaa

SEQ ID NO: 54355 - DNA, 318 bp, Homo sapiens
ctgtcaccaggctggagtgcagtggcacaatcatggctcactgcggcctcaccttcctgggctcaagtgatcctcctgcgtagctgggaccacaggcgtgcaccaccatgcccagctaatttaatttcttcacacttttccttggccctgttgtgtttagctgacttcatatacttcatgttaagctgttgttacttagtggctcaaaaatcaacaggctagcaggagtttgagaccagcctgagcaacacaagacctcgtctctaaaaaaatgtttttttttttttaattacccaggcatgatggtcacatgcctat

SEQ ID NO: 54356 - DNA, 5522 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccata

SEQ ID NO: 54357 - DNA, 5704 bp, Homo sapiens
ggaaagaggtttaattgactcacaattccacatggctgtaggtcagggcagtggggttcacaatcatggaggaaggcaaggatgagcgaagtcatgtcttacacggtggcaggcaagagagcatgtgcaggggaactgccctctataaaatcatcagatcttgtgacatatattcactaccacgagaacagcttgggaaagatgcacacccgtgattcgattacctccctccaggtccctctcatatcacacgggaattatgggagctacaattcaagatgagatttgggtggggatacagccaaaccatatcattcatcatctgagggaactgtggtctcagacagctgggcactgagagtgcacgctgccccctagaattccacacctacatcacagagagacagaacagtctcaaaggattcttaaggttaatgtggggagccaaaggaggagatgaattcacagcttgtgccttaccttctggtctaactaaaactacttttgtcctggcccaacaagattcccagactcttttctgggttgcaccaggggtaattcagaaagacaaaaagttattaatgcccctccattccccacagctcctgaggtctaagttgttcattccctgggttttaggttgttgttctccctctgcttccacagaatcagtgtgccccattccagtacctatgatttcacctgtattcttgtcacttcctactttctcctagacattttatctaacagagccaggtgaaacagagacaaggatatttacataaaacttaaacagaactaagttggagttccataacccccattgggctgggatggcactcaggctggcctaagattgtggttatggaacagaaagacacatttcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattccttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtctttttttttttaaggagaaaatgtttcttttaaataaatgtttcttatgtaaaaatgttgacatgagtttgct

SEQ ID NO: 54358 - DNA, 4373 bp, Homo sapiens
agcactcaagaaattatgattattttgaccttagacctctcttaactgtctgaaactggggtttcttattttcaggggaagaaacaggacacaggcagtctagaggctcctgccagccgagacaatctccaattaaaagtcggcatcgattaaatatttgctgaacaaagtaaactgtctctccaccgccgggctgagcgcccactcgagatccggcccggaacaagggcgagactggcccgcgggtcccacactccctgtaaggggtggagaacacgcccacacgcccagaccaacaggcgaggctgttcgaggaccttgttagccacctcagccccgcccgccgcgagccttctgctggcctcccgttctgcagggaccctccctagccagcccggccgcgtcccacatccgccgacacgccccttccggcctaatccccgcccctcaagcaccggccccgccccataggccccgtccgtggccccgccccgccgcgagctggcgccgggtcctctcagcgcccgccggcggccgcgtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatgggatagctcagctcaggtacttctcagtgtgtctacgctgctactgcttatggggtcc

SEQ ID NO: 54359 - DNA, 669 bp, Homo sapiens
ggctgagatgggagatttacctgagcctgggaactcaaggctgcagtgagtggtgattgcaccactgcactccagcctgggtgatgggagtgagaccctgtctcaaaaaacaaaatccaaatatgttgattagccatttacatgtttgtagtttttttttttttaatttcagtgaattgcctgttcatagcttttttctacttttcaggagtgtttgcatttttcttattgatatctaataactctttatatctgaaggatatgaacgctttgtgatacaggttacagattttggggtttttttctccgcttgctgtgagccttttgggtttgtttcctagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttca

SEQ ID NO: 54360 - DNA, 876 bp, Homo sapiens
ggctgagatgggagatttacctgagcctgggaactcaaggctgcagtgagtggtgattgcaccactgcactccagcctgggtgatgggagtgagaccctgtctcaaaaaacaaaatccaaatatgttgattagccatttacatgtttgtagtttttttttttttaatttcagtgaattgcctgttcatagcttttttctacttttcaggagtgtttgcatttttcttattgatatctaataactctttatatctgaaggatatgaacgctttgtgatacaggttacagattttggggtttttttctccgcttgctgtgagccttttgggtttgtttcctagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttcataggcttctttagctgtcttccttttaccccggacgggatgtagatgttaattctggaacaattgcagctacaagaatttgtcatcctgccccttttgagaaaaacattgtttgcccttgggtctaaatccttccagatgggatgggatgtatcttgtcacctcctttttcttacttaatatgaaaagacctttcctcatcaagtcc

SEQ ID NO: 54361 - DNA, 411 bp, Homo sapiens
tttggggtttttttctcccgccctttggcttgataggaagaaccccctttttttggggggttttttgttttttccccctaaggctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttca

SEQ ID NO: 54362 - DNA, 847 bp, Homo sapiens
ggtattttaagaaccagttacctcagacctcatgttgaacagtgtcgccatctgggtcctcttgatactgcagacttttaacgtacacatgcaggaaccctgctgagcgtgggcacttgttttaaagcaaaactcttcccaaggactgaagaaagggcttctggcaagctcgtcatggcattgtggtgggatgggtctagagtgtcatctgaatggtgcttcctgtgttcctctttgaattctgccattttcagtattcttgtgtgtctgaataggcaaagcgatttaattggctggtcttgcacgcaaattagttccaaagataagctctttgtaacacatttccagtcactaatgctcaaatgtagaacattcctttaaatggcaggataaaaaacccactatccaccatagtgcattttgggaagatgtctgtagcatatgttgctgtgaaattaggccttgtgggatatggctgtttgtcattttgatgtattttaaataaatatatatattttttaaagagccttttttaccagttcaaaaagtttaattaaccagcagtcaccgcatctgaatttttgtctctggggcatagatggcagaccaagattaaaagtggtaactcagctatacgagcatgggctaccttcctgggctctcctgcagtcctgtagacctgctgttccgcagaccatgggacacaaggtcagtgtgttcccagtgagggtcccaagtcagtcatcttaagtgtttgttctctgccccattcagtggactgttgacttcagtccctgcaagtgctttagcccgagtggggttttctcagagcactgccacgagttaa

SEQ ID NO: 54363 - DNA, 366 bp, Homo sapiens
gaggtttcaccacgatggtcaggctggtatcaaactcctgatctcaggtgagccacccgcctcagtctcccaaagtgctgggactacaggcgtgagcaccgcacctggtcaaggcttgaactttctaatgggccatagctcttgtagtgggctgcactcttctaaattacctggtccctgcaccatagtccaaaggtttaagcagaaacctcaatgcacttgatgttactggccctctttgtacagaggataaatatgctaattctcttccttaggagttagccctgagaaggaaaagctcaatgttgtcaaatgcaacaggtccaccccactgaggggttccccttttaaattcttcatgggttt

SEQ ID NO: 54364 - DNA, 623 bp, Homo sapiens
tcctgtattctgctttgtgctgaccctgtaatctcagcagtacccattcgcctagcagggcttcgggatgcttccccgactctcctcgcaccttcacaccaacgcactccgggaatgtttctgatgggtgtcaagtccactctctgatgaacggactcgtgctttgagagcatcttcagggtcagtgcatccagtgaccgtttcatgacaccgtttgcctcgagcgccaccgcctggccaaaactggaacgacctgtgcccgttgctgaggaggaaaaacacccgggatggaatttctagtttttgtgcaatcctcatccttttccattttctgtaaagtgacgatgacagatattttcgcttactaatgcaagtatttttcatctgaataaatataccaatttctctggcaataatttgggtttaaaaatactgaggctggcccggcacagtggctcacacctgtaatcccagcactttgggaggccaaggcgggcggatcacgaggtcaggagttcgagaccatcctggccaacatggtgaaaccccgtctctactaaaaatacaaaaattagccgggtttggtggcgtgcgcctgtaatcccagctactcgcgaggctga

SEQ ID NO: 54365 - DNA, 383 bp, Homo sapiens
cccacctaaactgttcctgctgtgattatggctgctatgcatttatcttcccatgtttctgtgattttctccctcaattatcccttcctgagaaccatcaccatcaggcatgcctctcgcctttttcttccattactcaaacctcctcttgcctacagttcttcctctggcatatccatgcagctctgctctctttccctaccgcgtttctggccgttccttgtgtctcccaactgcatattcacccacctgactgtatggctaggagtctgtccctattatcaatgggcagaacttttcccactccccacctgggttggggaaggggagtggggtgtgggagccagggaaggagcccatagttagagattggtgagtatcga

SEQ ID NO: 54366 - DNA, 470 bp, Homo sapiens
agcgtcgatcacaatccaggtttgtatatcctggctttcagaccccttagggcatgctttctgggctcctgctagacatggtgtcaggtgccacctggaggcagcatagcaacctgattagggcccaagcagaatcactgctggcctcaatcccaactcctggctatgtgatcttgaatgcccatttcctcacctgcaaaatggggataataaagaactcacatctgaggtccttgtgagaatgaaaataagataaatgaaggtatacagcttattagtaagtgcttgaaacagagcatttcacctctctgagacttagatgtgtcctctataaaatggtgtattcttggccaggcatagtggctcatgcctataagcctagcactttgggaggccaaggcagacagatcacttgagcccatgagttcaagaccagcctgggcaacatggtgaaatactgtccctacaaa

SEQ ID NO: 54367 - DNA, 846 bp, Homo sapiens
aagcaagtaaaatatttatccgtttatttcagcgcaggatcgggtcatgagtggccagagcctatcctgcttagggtacaaagcaggaaacagccctggacaggacgccacccccatcgcagggcttactcatacacacgctcacactcagactgggactgtttacacatgccagctaacctaacatgcacagttttgtgatgtgggagtacctggagaaaacccatgccaacatgaggagaacatgcaaacagacagtggccccagccaggagtcagatttttttcccatcaacgttataaccaaatgacattggacaaaatattattcaagaacctgctataaataggaaagtttgcttctgtcctagggcttcatctatgaaactggaagagattgcagtgaaaccctttccatttcagcatcaatatgccttcaaagatgctgggactgacttatgaagccagcctgataacagaggacttcaccatgagcgcaggcccagagcattggtgatgggaaagcagagacttgtgttgtttcctaagggagctcagcactctctgtctgagtggttttctaaaattaatgttacacatctctgatggtctgttgaagtcagaggcatctgtcctaaaccaaagtaggtagaaaaattaaagtaatatttaactatgtttccatatctaaacataactgtcacttaagatgcttttagtggcagttgttttagaagcaattcaaactggctcaaacaagaagtgttattatatcacttaacgagaactgttcttatcacaatgtaagttgaagttaatataatctgaaaaaaaagccattagtttg

SEQ ID NO: 54368 - DNA, 277 bp, Homo sapiens
tatttgtagtacatattatagtgtatatccatataactataaacaaagcatactgtatgcttaaaaatgtacatgaagtcaagctaggcgcagtggctcacacttgtaatcccagcactttgggaggccgaggtggacagatcacaaggtcaggagtttgagacctgcctggacaacatggtgaaaccccgtctgtactaaaaatacaaaaaatagctgggtgtggtggcgtgcgcctgtaatctgagctacttgggaggctgaggcagaagaatct

SEQ ID NO: 54369 - DNA, 449 bp, Homo sapiens
gttggtgaagcatgcctcagagttgagatgacatcagggatgtacccttaatggtaatgccctttgtcatcaggtccttgcaaggaataaggtgacatcaagcatatccttttagtaacaacagggtgcctacaaactatcaaggtgtggcctacagcagcctgatgtgggggtacacattgtcagacgtagagaggcatattgccaaaggaatttggctgtggcttctgacacacagtgggctggagtcaaatacatagaaaactcctgagatgcttgagagatcgctctgggcaaaggcatcgcccaggactcaaggaaactgagactgtttgaacctaaagaaccttaggtcccaacttcccacaggcaggaagaagctgaaagttactctgctaccaaagggactgttttccaacatcctcatcagaagttgaaaggacgatgga

SEQ ID NO: 54370 - DNA, 202 bp, Homo sapiens
tttgcatccatatacatgtaatcccactgcatccccacactctgagggtgggactgttattctccctgttttacagatggggaaactgaggctttgagcaatgcagcagtttgccccagactacagagctatgggctacatcaggatgtaaaaatgtgtttcttactgcgtggcatggtgaaaacatgttggggaggcatga

SEQ ID NO: 54371 - DNA, 234 bp, Homo sapiens
atttggtggcatagagtattctatcgatcagtggtcaaaagagtagtcattctgagtgatctctaacattagggttgatggaagagatgacccatagatgtccctacatctcatttctcttaggacacacacttgggagaaatcgtccagtgcactttgtccaggccttttacttgtaccaactactttgctttatgctgttttcactttagtggttctgccttctagtccaca

SEQ ID NO: 54372 - DNA, 376 bp, Homo sapiens
gcggcccattctgcagatgttggtgaggttggtatttctgtggaggtgtcagcaaaggttgaatgcgccaggcatgaggcaaaggccaaggtttagggggacttctacacacacacctgcccccttgccttgtccagccagaaagcagagagcagtggcatctgcccagcacagaggcagatgggtggatccactcacccgaggatagagcagggaagacgggacaggagaaatccaagagggcttctcaggggaggaggcgtgtagtttggcttagatacagaggctagacaggggcctgagcagatgagtaggggactgggcatttgaagccaagagtcttgcacctccctacccctttctttgcaccctcata

SEQ ID NO: 54373 - DNA, 681 bp, Homo sapiens
agtgagtggccaggcaggtgcctgctcctgcaaccctgaagccgggaaagggtggtctctctccccatccttgacatagaaatcaccacccgacatttttgctgttttaaaacagttcatcctgccatggtaagtgatggcaaacatctgtgtcatttcattctcaaaggcccaccttctgtgtgctgcctgcttctggacactttcctgatggtcctgctggaaataccgtccctgccgctatgagtttgagagcgggcttcagcctccccatgatgcagcacatgctgcctgggatggcgctgcttgtgtcaatctccctgaaatgaagcaccctctgtccaggggactatgttctatttgtcgaaacttcacaggacataagtcactgctgggcctgtgctctttactttcttcaccaatctctctgctccccacataatactagacatatttccaacccctgaaattcccaactgctctctcatatataagtaagcaaaggaaaaattatgtggaagaatttttttttgatgtcaagaaaagaggaatttaggctggctgcagtggctcatgcctgtagtcccagctactcaggaggctgaggtaggagaatcccttgaaccaggaggcggaggttgcagtgacctgagtttgcgccactgcacttcagactgggtg

SEQ ID NO: 54374 - DNA, 457 bp, Homo sapiens
actgtaggccctcagattaagaaacggattcatcaaccaataaaacatacctttctacaaaccccttccccataaaagccaagctctctctttattttggttaacattttttttttcctgagtctgcttgctagggaactgttgaaatattaagccatctaagagcaaaggatatctttgttccccagaaagtaaaagaaaaagtaaaaaaatttaccaagcttaacttatatataagtcctagatctaatataagtcatttaatttatccttaaaacgtagaaaactattaaaactctattttctgatctcaaaggtgacttctgcttgtaacattaagtgctaagtggtagtttcatactttcaaatacaaattatcaattttaaaattaaaaaaattttgaattgggaatctaagtggtgtaaaagtcaaagggttcaaaatgatatttagtaa

SEQ ID NO: 54375 - DNA, 480 bp, Homo sapiens
cttctggggtccacaatgttgctttgctccatcaggctgaccagggtggaatccctgaccactcctgctggacaagagtggtccttggacaagacccttgatctccctgggcttccattttttctcattctgagaaaaaaaaaaatttaaatagaccagatcagatggactctaagggctccttcaatgaaggtccccctgtgccctgagtggggagaaaggttggagacagaagagaaggaaagccctctcctaagcaccctagatgctgcctcgtagttggtcctaagtccactacttctctaagccaccaaggcctcctctggctccaagggcaagtccagtttcccactcacacatttttcctcttactggtgatcgtgtaaatgcatgatctgaacagccctccacggtcagcatgttccttccccttgtgccattccccagctgagcttgtaaaaataaacataaaatgtgcag

SEQ ID NO: 54376 - DNA, 470 bp, Homo sapiens
gcccttttcacataagtaattttacttcatcttcattaatatgatttttatagatgaccaaatggaagttaaatgatttaacaaggccatacagctagaaagtgtctggactaagatttgaatccagatggggttaactccaaaaccagtatgtttagtttctataagaatcatggatagattaggcacaggggcttatgcctctaatcccaccactttgggaggttgaagtgagaggatcccttgaggtcagggagattgagaccagcctgggcagcatagtgagtcccctatatcgctctctctaaaaaaaaataaataaaaagccatttgtgttgttatgcacctgtagtctcagctacttgggaggctgaggctggaggattacttgagcccaggagttcaaggctgcaatgagctatgattgtgccactgcattttaacctgggagacagcaggactttctcaaa

SEQ ID NO: 54377 - DNA, 443 bp, Homo sapiens
ctctacaatctctttcgacagatggaagcagagggaacagttcctaactcattctgtgaggctagtttcaccctaataccaaaaccggtcaaagacattacaagaaaagaaaactatagaccaatatctctcataaacatagatgcaaaatccccaacaaaatacagtcatatgctgcatagtgatgttttggtcaatgatagaccatatacatgatgcggtaccataagattataatggaactgaaaaactcctattgcctagtgacatcataacatcatagcaaaacacattactcatgtctctgtggtaatcctggtgttaacttgccgcattgccagttgcataaaagcatagtatgtacaattatgtgcagtacataatacttgatatgttactagtttatgtatttattacatacttttatcattatttagagtgaa

SEQ ID NO: 54378 - DNA, 164 bp, Homo sapiens
gttgggagaggagagccacgaggcaggacatgtgcatttcttgctccctcctttgtgcttggcctggtgcatccagtgtggtccaggcacgctgcagctccagcagctctgtgaggcgggagcgtcatctcgtctgtccttagtgccagtccagggtgcagtcc

SEQ ID NO: 54379 - DNA, 210 bp, Homo sapiens
ttgacattgaggaaacctttgccataaataatccctgctattcaagagaacatttatcctcttgctgcagagtgaagacaaaagagtcaacgaagttttcaggaggcgatcacagactctgggagctctctttaggaagattaagaaaggcacaacaggcatcagaaccataatgatggataaaacaaataaagaggtgttgagttgctg

SEQ ID NO: 54380 - DNA, 876 bp, Homo sapiens
tatttttatattatttatttattctttgttagtttttggagtgtgggttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttccggtgacgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggaaggggagtgagctgacgctcggaaggtgtcttgagattat

SEQ ID NO: 54381 - DNA, 1187 bp, Homo sapiens
tatttttatattatttatttattctttgttagtttttggagtgtgggttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttccggtgacgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttggtttctgcctcagcctcctgagtagctaagggaggtgtcttgagattatcatcggctgaggtggaagcagaccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtggcttgatattatcatctgctgagggtggaaggggagtgagctgacgctcggaaggtgtcttgagattatcatccgctgagggtggaagcggcccccgcagacgctcggcaggtggcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggaaggggagtgagctgacgctcggaaggtgtcttgagattat

SEQ ID NO: 54382 - DNA, 983 bp, Homo sapiens
tatttttatattatttatttattctttgttagtttttggagtgtgggttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttccggtgacgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgaggtggaagcagaccccgcagacgctcggcaggtgtcttgatattatcatctgctgagggtggagctgagggtggaaggggagtgagctgacgctcggaaggtgtcttgagattatcatccgctgagggtggaagcgcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggaaggggagtgagctgacgctcggaaggtgtcttgagattat

SEQ ID NO: 54383 - DNA, 392 bp, Homo sapiens
tccttggaggggcttctgggtggccagccgtgtattgttgcttggttgtgcttttagggttgtctggcttgtgtgggtgctgggtttgtcggtgcagagagcacagctggttccaggctggcttcagaaggctgcaggcagattcctggggagagggtgacactatagcgccagttcttcttacagccttgttctgcactttctaaaaatattcctgacaaacagctaatgggcattttggccattctattgccaaactattgctgccatttcaaatggaatgcttctccttcaagcctgttcatcttgacttatatgatggggatagattcatccgtttcatgggacttcacaacagcccactcaccagaggctctttgaaaacaatcaag

SEQ ID NO: 54384 - DNA, 395 bp, Homo sapiens
cagaggtgccccagactttttaaccaggacaccctccaacatcagaggagagggaattaatgaataccctgagtagcctaagacatagccaaaagctgccctagcacaaacatcttcattcttggctattcatgtacattttcctttctactcagggacatatttgctgtgttgacagttaaatttttttttctccgacctattagtgaaattgacagaccaaaaatttgtaccaaatatagcctgtgccattttgggggaacacatgtctgtcaaaaggacagaacatacatacagcagtcaaccaaagtccttacagaaaaacatgatcaacaaggagaaaagagcagaatataaaccaagcacctattgctcaaacagtgaactgagactgc

SEQ ID NO: 54385 - DNA, 2436 bp, Homo sapiens
cagccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcgccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatc

SEQ ID NO: 54386 - DNA, 984 bp, Homo sapiens
ccggtctaggtagagtgcttgtgttactctggacgaggctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggaggtacctctcgggtggaccttggccccagggtcctggaggaggaggggacagggccctggactcctgggtctgagggaggaggggctggggacccctgggtaataaaggaggaggggtaaggccaggcgaggtggctcatgcctgtaatcccagcattttgggaggcagaggcaggcggatcacctgaggtcaggagttccagaccagcctggccaacataatgaaaccccgtctctactaaagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaa

SEQ ID NO: 54387 - DNA, 853 bp, Homo sapiens
  misc_feature (483)..(483): n is a, c, g, or t
  misc_feature (486)..(486): n is a, c, g, or t
  misc_feature (497)..(497): n is a, c, g, or t
  misc_feature (517)..(517): n is a, c, g, or t
  misc_feature (539)..(539): n is a, c, g, or t
  misc_feature (554)..(554): n is a, c, g, or t
  misc_feature (571)..(571): n is a, c, g, or t
  misc_feature (592)..(592): n is a, c, g, or t
  misc_feature (653)..(653): n is a, c, g, or t
  misc_feature (696)..(696): n is a, c, g, or t
  misc_feature (704)..(705): n is a, c, g, or t
  misc_feature (712)..(712): n is a, c, g, or t
  misc_feature (723)..(723): n is a, c, g, or t
  misc_feature (737)..(738): n is a, c, g, or t
  misc_feature (742)..(742): n is a, c, g, or t
  misc_feature (746)..(746): n is a, c, g, or t
  misc_feature (751)..(751): n is a, c, g, or t
  misc_feature (769)..(769): n is a, c, g, or t
  misc_feature (780)..(780): n is a, c, g, or t
  misc_feature (785)..(785): n is a, c, g, or t
  misc_feature (787)..(787): n is a, c, g, or t
  misc_feature (810)..(810): n is a, c, g, or t
cagccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggcccataagcggcataccngtntttgccccacncgcggcccctgcggtatccncccacaaagggacactgtactntaatgaagaccatcngccccggcgatcgcccncctgtccccagccggccccgngccccccggtcccccaccactccccgtgtgtatgcgccaccgggccgtcgcctgtgtcggngccccgttgacgcatgtcccccccgcgcggactcccatgtctnccgaccgnnccaggtnccgggacggcnctcagggccttgcnnctcncctnccccnggcacccctctcacctancggcttccgcncgggngnggaccggcgcgcgcccgctatanccctgacgccgacccactttcagcatggcccgaggggccgccc

SEQ ID NO: 54388 - DNA, 2455 bp, Homo sapiens
ccggtctaggtagagtgcttgtgttactctggacgaggctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcgccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatc

SEQ ID NO: 54389 - DNA, 2465 bp, Homo sapiens
  misc_feature (2225)..(2225): n is a, c, g, or t
ccggtctaggtagagtgcttgtgttactctggacgaggctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcgccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacncccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactcc

SEQ ID NO: 54390 - DNA, 287 bp, Homo sapiens
gtcattgtgcagctgttattcagttcatgcacagacaacaaagcatgtagatgttttgactccatgaatctcagtgataaacacaagtgacattttacaaagatcaattaaaaagagagaaaactggacaacatagacgaggttgcaacaaagaaatagaaagtaagaatattggaaatgaaatttgaatacaatatatatggagtcacagaataaattgttgatcatgggaatgttgacatcatttcaaagactctagatatgcaaccagatgaacctaaagaaga

SEQ ID NO: 54391 - DNA, 555 bp, Homo sapiens
actcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaacca

SEQ ID NO: 54392 - DNA, 294 bp, Homo sapiens
gtacctggctcaggcctaaagtacagagagcacaactagtgcaggaagatccgttaggaagcaacgcgagtagttgaggaagaggtgacggggtttggaccaaactggggacaggcagattggagtagacattggagagggcatccagaggcggggtcggcaccaggagatgtgggcgccagaggaaggggaaggaggttctgagggtgacccccacccccactctcaggggaaggacgctggcctgctccaagctggcttcctggagggaaggcaggtttctgtagacagacg

SEQ ID NO: 54393 - DNA, 553 bp, Homo sapiens
tctgcttggggtgctggacaagcagaaggggaacactcaagttctttctctccataactgccttcgggaagccatggcagatgcgttgactctctgtagggctggcaagctgtgtggcgagtcccttatccaatgtcgctgtgtcccacagggaggtcttaaagaggcagccgacttttgtggcctccttgtgaaagcttcgatgcctcagggattatttctgagctgactgctagttggacttgggcccactgaagagacagcctgggatcggatgtccagaagagacagatctgagcacgtctctttcctctccctcctcttttcttcttagcccttccacctatcactcattcattgccccttcctaggttctgtattcatttgctgggggctttaacaatgagacgttattttctcccagtctggaggctggaagttcaaggcctaggtgccagcaggattggggtccctggagccctccctccttggctaggagatggccgcccccttgctctgagcccacatggtccttcctgtatgcacctgcacc

SEQ ID NO: 54394 - DNA, 688 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccaggtgaggggacggcctgaagcgaagcgtggggcggggcagaaggcagcgccaaggtccggctggctgcggccggccggtggtggggcccgcgcgggtcgtcctcgtccgccgggtgatggaagagcggcgaccgcgcgctttcctcgtggcgccgccagggcctggcgcgtggccgccgctcctcttccccctcccctctccacccttcccttcccccctcccttttcattcggtcgcgcgcctaggcatgcggaaggttccagaaaacgtgaagggcgggggctgtggtcgctagtgagttctggccggga

SEQ ID NO: 54395 - DNA, 907 bp, Homo sapiens
  misc_feature (885)..(885): n is a, c, g, or t
  misc_feature (900)..(900): n is a, c, g, or t
  misc_feature (907)..(907): n is a, c, g, or t
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaatgatctagagtccacaccaatggtatatctggtcagcatgatggaggttngtcttgatgtgaggntgccctn

SEQ ID NO: 54396 - DNA, 3572 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54397 - DNA, 2637 bp, Homo sapiens
tggtgaggccccgggtatatcggccgaggccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54398 - DNA, 2613 bp, Homo sapiens
aaggctagagaggctgggtgttaatcggccgaggtgctgtcctgattgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54399 - DNA, 2273 bp, Homo sapiens
gctaggtggaggccggtgtaaatcggacgaggttaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54400 - DNA, 3367 bp, Homo sapiens
  misc_feature (47)..(47): n is a, c, g, or t
taaacgcggaaccaaacacaaaaatcaagttggaacaaccggggaancaacgctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54401 - DNA, 3713 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54402 - DNA, 2599 bp, Homo sapiens
cggtaccccatacaccgcaatctcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54403 - DNA, 2273 bp, Homo sapiens
caggctcggacctctccctactgtatcctagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54404 - DNA, 1295 bp, Homo sapiens
ccaacaatcgagccggacgtagtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54405 - DNA, 1266 bp, Homo sapiens
  misc_feature (1)..(1): n is a, c, g, or t
  misc_feature (24)..(24): n is a, c, g, or t
  misc_feature (30)..(30): n is a, c, g, or t
  misc_feature (33)..(33): n is a, c, g, or t
nattcggaacgaggcctagtgcgnattcgngangacttttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54406 - DNA, 3895 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaaaaaaaaaatcttttaaaagctgccatctgaggtgatggcttctctgtacttacgccatcgcccagaatacaataaataagcaattaggtcgaccggccgcgaatttagtagtagtagtaggcggccgc

SEQ ID NO: 54407 - DNA, 4772 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagcttagttttaagggttgtatgatgttttcatctgagaagttctgaaacgtgatttctagtcaatatcttgcagagataaataatgcaaattagctgaaaatgctataaatttccaaaggcttaaatttcatttatggcaggttgtgtagaaaatccgcagaccacactgctcttgaacctaggagctacatgcatagagaatagccacttggattacatttctaccaacatctgaatggtggtccagcttgtcctgcaaatgtagagccaaggagtgcttgcttatgcctgtttgcatggagacttaaaaacttggaaatttggaggccaggcggagtggcctgtaatataggccactatatagtaatataggcgtgagcctataatcctagcactttgggaggccaaggcatgcagatcacgagaccatcctggctaacacagcgaaaccctgtctctactaaaaatataaaaaag

SEQ ID NO: 54408 - DNA, 3805 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaggggtagacctaacgtctttacgtgggtacttgcgctta

SEQ ID NO: 54409 - DNA, 3756 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgataggcacgagctcgtgccgaa

SEQ ID NO: 54410 - DNA, 949 bp, Homo sapiens
ccgacccaatgaattgatatgagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54411 - DNA, 4070 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatggaggtttattacgtatgtctggttctcaattccaacagtttaatgaagatctaaataaaatgctaggttctaccttaaaaaaaaaaaaaaaaaactcgagtttttttttttttttttaagaccctcatcaatagatggagacatacagaaatagtcaaaccacatctacaaaatgccagtatcaggcggcggcttcgaagccaaagtgatgtttggatgtaaagtgaaatattagttggcggatgaagcagatagtgaggaaagttgagccaataatgacgtgaagtccgtggaagcctgtggctacaaaaaatgttgagccgtagatgccgtcggaaatggtgaagggagactcgaagtactctgaggcttgtaggagggtaaaatagagacccagtaaaattgtaataagcagtgcttgaattatctcgtgccg

SEQ ID NO: 54412 - DNA, 3691 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagatgagtggcaatgaggtgggcagaagag

SEQ ID NO: 54413 - DNA, 3748 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54414 - DNA, 3236 bp, Homo sapiens
  misc_feature (3210)..(3210): n is a, c, g, or t
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactccgtactcctnactcccatcggcaggccagtactgat

SEQ ID NO: 54415 - DNA, 3255 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgaaaaaaaaaaaaaaaaaaaaaaaaaaaaaaaaaaaaaaaaaaaaaaaaaaaaaaaaaaaaaggggggggggggaaaaaaaaaccgaggggggcccaagatgcgccacacagactactttcggtgaaggaggggccccacataaggaggcgcaccaaaaacagacgagcgaaggaggcgcgcggaacaaacgacgcagtgaggaggaccagccgccaccggggacctggagaagaaacccctctgcggggccaaactcggcgcacacccacaaagataagcccgagaggaaaacactccgtggacggggggacacgaaccatgtgggcaaacggcaggaaaagaatcacagagaagacg

SEQ ID NO: 54416 - DNA, 2923 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagagggaaatggggggagttattgtttaatgggtacagagtttccatttgagatgatgaaaaagtcctggtgataaatagtggtgacagttatacaacattgtgaatgtacttaatgcgactgaactgtacagttaaaaatggataagatagcaaattttatgtatataaaacaataataaaaaatagca

SEQ ID NO: 54417 - DNA, 3847 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagcttagttttaagggttgtatgatgttttcatctgagaagttctgaaacgtgatttctagtcaatatcttgcagagataaataatgcaaattagctgaaaatgctataaatttccaaaggcttaaatttcatttatggcaggttgtgtagaaaatccgcagaccacactgctcttgaacctaggagctacatgcatagagaatagccacttggattacatttctaccaacatctgaatggtggtccagcttgtcctgcaaatgtagagccaaggagtgcttgcttatgcctgtttgcatggagacttaaaaacttggaaatttggaggccaggcggagtggcctgtaatataggccactatatagtaatataggcgtgagcctataatcctagcactttgggaggccaaggcatgcagatcacgagaccatcctggctaacacagcgaaaccctgtctctactaaaaatataaaaaag

SEQ ID NO: 54418 - DNA, 2685 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatggacaataaagtaaatagcaggatacacatatagaccactgatatcggggtacgc

SEQ ID NO: 54419 - DNA, 1936 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtggtgtgactcaggtggtgtgactcaggtggtgtgactcaggtg

SEQ ID NO: 54420 - DNA, 1091 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcaggtaatgtcattttgttgcatttttctggatttttgat

SEQ ID NO: 54421 - DNA, 872 bp, Homo sapiens
  misc_feature (47)..(47): n is a, c, g, or t
taaacgcggaaccaaacacaaaaatcaagttggaacaaccggggaancaacgctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggaccgtcaagggattataccaaggtcgaccgttcctgctttgctg

SEQ ID NO: 54422 - DNA, 960 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaaaagtaagtgatgatcataaagcttggttgtctcatttattac

SEQ ID NO: 54423 - DNA, 2981 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54424 - DNA, 3766 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtgtatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcagaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54425 - DNA, 2735 bp, Homo sapiens
  misc_feature (47)..(47): n is a, c, g, or t
taaacgcggaaccaaacacaaaaatcaagttggaacaaccggggaancaacgctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54426 - DNA, 3064 bp, Homo sapiens
gcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54427 - DNA, 2591 bp, Homo sapiens
  misc_feature (47)..(47): n is a, c, g, or t
taaacgcggaaccaaacacaaaaatcaagttggaacaaccggggaancaacgctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccaggttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctacctta

SEQ ID NO: 54428 - DNA, 1297 bp, Homo sapiens
atttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggcatgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccaggatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgc

SEQ ID NO: 54429 - DNA, 1687 bp, Homo sapiens
  misc_feature (1309)..(1309): n is a, c, g, or t
  misc_feature (1316)..(1316): n is a, c, g, or t
  misc_feature (1319)..(1319): n is a, c, g, or t
  misc_feature (1322)..(1322): n is a, c, g, or t
  misc_feature (1325)..(1325): n is a, c, g, or t
  misc_feature (1328)..(1328): n is a, c, g, or t
  misc_feature (1333)..(1333): n is a, c, g, or t
  misc_feature (1341)..(1341): n is a, c, g, or t
  misc_feature (1349)..(1349): n is a, c, g, or t
acacagagacaccggggcccagggcccgcctgatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaacacatgagccaaaagctgaattaacatatatactacatttgggcactgacagtaaaaacaattttgactttaaaaagccataggtagggccccgcatcacgggccccttggcccaaaccccccttattctacacttctttcccttttacgcccagtcttttctaaacttccagcatggttatcccctggcgcggaaaccacgtgaatcttcgttgacttaactcctctattgagccgatttacatttccggggcgcggagttaaaccagcccgccaccgtaaaatcccagatgtttcttaagctaattcgcatttgatgccaagtcctcttccc

SEQ ID NO: 54430 - DNA, 2080 bp, Homo sapiens
  misc_feature (1702)..(1702): n is a, c, g, or t
  misc_feature (1709)..(1709): n is a, c, g, or t
  misc_feature (1712)..(1712): n is a, c, g, or t
  misc_feature (1715)..(1715): n is a, c, g, or t
  misc_feature (1718)..(1718): n is a, c, g, or t
  misc_feature (1721)..(1721): n is a, c, g, or t
  misc_feature (1726)..(1726): n is a, c, g, or t
  misc_feature (1734)..(1734): n is a, c, g, or t
  misc_feature (1742)..(1742): n is a, c, g, or t
atttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggcatgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaacacatgagccaaaagctgaattaacatatatactacatttgggcactgacagtaaaaacaattttgactttaaaaagccataggtagggccccgcatcacgggccccttggcccaaaccccccttattctacacttctttcccttttacgcccagtcttttctaaacttccagcatggttatcccctggcgcggaaaccacgtgaatcttcgttgacttaactcctctattgagccgatttacatttccggggcgcggagttaaaccagcccgccaccgtaaaatcccagatgtttcttaagctaattcgcatttgatgccaagtcctcttccc

SEQ ID NO: 54431 - DNA, 2030 bp, Homo sapiens
  misc_feature (1652)..(1652): n is a, c, g, or t
  misc_feature (1659)..(1659): n is a, c, g, or t
  misc_feature (1662)..(1662): n is a, c, g, or t
  misc_feature (1665)..(1665): n is a, c, g, or t
  misc_feature (1668)..(1668): n is a, c, g, or t
  misc_feature (1671)..(1671): n is a, c, g, or t
  misc_feature (1676)..(1676): n is a, c, g, or t
  misc_feature (1684)..(1684): n is a, c, g, or t
  misc_feature (1692)..(1692): n is a, c, g, or t
atttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggcatgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaacacatgagccaaaagctgaattaacatatatactacatttgggcactgacagtaaaaacaattttgactttaaaaagccataggtagggccccgcatcacgggccccttggcccaaaccccccttattctacacttctttcccttttacgcccagtcttttctaaacttccagcatggttatcccctggcgcggaaaccacgtgaatcttcgttgacttaactcctctattgagccgatttacatttccggggcgcggagttaaaccagcccgccaccgtaaaatcccagatgtttcttaagctaattcgcatttgatgccaagtcctcttccc

SEQ ID NO: 54432 - DNA, 2100 bp, Homo sapiens
  misc_feature (1722)..(1722): n is a, c, g, or t
  misc_feature (1729)..(1729): n is a, c, g, or t
  misc_feature (1732)..(1732): n is a, c, g, or t
  misc_feature (1735)..(1735): n is a, c, g, or t
  misc_feature (1738)..(1738): n is a, c, g, or t
  misc_feature (1741)..(1741): n is a, c, g, or t
  misc_feature (1746)..(1746): n is a, c, g, or t
  misc_feature (1754)..(1754): n is a, c, g, or t
  misc_feature (1762)..(1762): n is a, c, g, or t
atttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggcatgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcaggtgaggacccggagggtctgggaggctggctggcctcggagagatcaccacccgccttctctctcctcagaaatttgtccagcaccacataggccctgtgaacacctggatgggcctccacgaccaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaacacatgagccaaaagctgaattaacatatatactacatttgggcactgacagtaaaaacaattttgactttaaaaagccataggtagggccccgcatcacgggccccttggcccaaaccccccttattctacacttctttcccttttacgcccagtcttttctaaacttccagcatggttatcccctggcgcggaaaccacgtgaatcttcgttgacttaactcctctattgagccgatttacatttccggggcgcggagttaaaccagcccgccaccgtaaaatcccagatgtttcttaagctaattcgcatttgatgccaagtcctcttccc

SEQ ID NO: 54433 - DNA, 722 bp, Homo sapiens
gaagcagttcgtgtctgacctgcggagcctgagctgtcagatggcggcgctccagggcaatggtaaggaggccagcccggcccgctctctgcctccccccttctctgggcagcgcttagcccctgcgccccgtttctcccgctcaggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcaggtgaggacccggagggtctgggaggctggctggcctcggagagatcaccacccgccttctctctcctcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgcctgcggatccgacctcctggggcccacagctggctctgtccccagggaactggaggccggagcagccggacgactggtacggccacgggctcggaggaggcgaggactgtgcccacttcaccgacgacggccgctggaacgacgacgtctgccagaggccctacc

SEQ ID NO: 54434 - DNA, 1299 bp, Homo sapiens
acacagagacaccggggcccagggcccgcctgatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagttcacaatgataacctgcaaactgcagaaagcgccacgggtttcaagctcctcaccttcg

SEQ ID NO: 54435 - DNA, 1670 bp, Homo sapiens
  misc_feature (1309)..(1309): n is a, c, g, or t
  misc_feature (1316)..(1316): n is a, c, g, or t
  misc_feature (1319)..(1319): n is a, c, g, or t
  misc_feature (1322)..(1322): n is a, c, g, or t
  misc_feature (1325)..(1325): n is a, c, g, or t
  misc_feature (1328)..(1328): n is a, c, g, or t
  misc_feature (1333)..(1333): n is a, c, g, or t
  misc_feature (1341)..(1341): n is a, c, g, or t
  misc_feature (1349)..(1349): n is a, c, g, or t
acacagagacaccggggcccagggcccgcctgatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaaaactgagccatatgctgcattaataatcatactacattgtgtgacttgacaataaataccacttttgactttaaccagacctatactggagcccgaattccgggccttttggccctagctctggtatgcccccgggccctcactcgggaacacttggtcactaactccctctcttacgccgttttccaatctcactgaccgggcctgctacacgtatcgccctttccgaacactcccgatgttctccccagcttaatcgcatttgcaacacatcccctttttccacagatgctgcattcatactcttggccccccca

SEQ ID NO: 54436 - DNA, 1594 bp, Homo sapiens
  misc_feature (1216)..(1216): n is a, c, g, or t
  misc_feature (1223)..(1223): n is a, c, g, or t
  misc_feature (1226)..(1226): n is a, c, g, or t
  misc_feature (1229)..(1229): n is a, c, g, or t
  misc_feature (1232)..(1232): n is a, c, g, or t
  misc_feature (1235)..(1235): n is a, c, g, or t
  misc_feature (1240)..(1240): n is a, c, g, or t
  misc_feature (1248)..(1248): n is a, c, g, or t
  misc_feature (1256)..(1256): n is a, c, g, or t
acacagagacaccggggcccagggcccgcctgatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcaggtgaggacccggagggtctgggaggctggctggcctcggagagatcaccacccgccttctctctcctcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaaaaaaaaaaanaaaaaanaanaanatnaanaaacngaaataanaaaaaaanacaacacatgagccaaaagctgaattaacatatatactacatttgggcactgacagtaaaaacaattttgactttaaaaagccataggtagggccccgcatcacgggccccttggcccaaaccccccttattctacacttctttcccttttacgcccagtcttttctaaacttccagcatggttatcccctggcgcggaaaccacgtgaatcttcgttgacttaactcctctattgagccgatttacatttccggggcgcggagttaaaccagcccgccaccgtaaaatcccagatgtttcttaagctaattcgcatttgatgccaagtcctcttccc

SEQ ID NO: 54437 - DNA, 1267 bp, Homo sapiens
acacagagacaccggggcccagggcccgcctgatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatcttatccatatgaacaggtgcccttcatgcgtccgtttataggctctccacaagggtcgcattccactcccagagctatgaacatctgcttttctgcctcatgccg

SEQ ID NO: 54438 - DNA, 1451 bp, Homo sapiens
tcctgatatactgtctcttaaaataaaaataaaaatatttatatatagataaagagaaagtatggctacctaatgggcagtagatacagagagacagagaaaaatggggaaccttttagagcagttttcccctaacttcagttattcacatatcaccttcacattttgtgtgtgtgtgtgtgtgtgtgtgtgtgtgtgtgtgcgcgcgcgccagtgcaggaccgagattgagggaaagcatgtctcctgggtgacagagccagactcttgtctcaaaacaaacaaaaacaaacaaacaaaaaccctataaacataccaattacagtacctgcaaatgaaggttaagtgttaccaaattaataaatataattaattactgtttatttgctttagaaaataattggccatgaagccagaggaccatatctatcttgttcattgttgtattcccagcccctagcattgtgcctgagacatcacagatcccctttaaatacttgctgagtgaattcactttttaaataacagccacatttcatccttttgatctctccaaacttgatttagatgcaacttctccaggagtgcttatgttacccaaagagaaacagatgcacaaagagaaggaatgagatgctcggggatattttatcaaggaaaccagcaaaccgtctttttcctgaagaccttttaagattaggacaagcagctgtttataaaagcagaacagtgttaagatttgaactgtaaagtaggatcatgctttgaagtatattctagctaaaagcaggggataaactagataaaacttggagactctaagacctgaccctgattaagtgggcctacaagtgagaatctgaagaacagctctctggctgaacatatcccttggatgttgttattaccagctgcctctagatttgagaacagtgctgagcatgcttttaaatgatctttgaggtactttaagctagctacacctgaaagcatacctagccctcatttctgtttgcttgaacaagagcctgaaaaagaagtctaaagaactttctagtgatatccttcagtcctgttctaaaaagaacctgtgttcttcaccgagttaaggaaatttcacaactccccaggggctaatgtggagttcattttcacttactgctgaatcaactgaagttcctttcagagtcttttcctagagtggaaaagtatctgagctcttcaacctactattcattagtgctgagagacaaaaatcatgttagagtctataatgtaatggagcataaaacatttaagttatgaatctgcataaaatgtgtaaaagatgaaaaaacatactttaatgtttgtcagtacttattgatcagtgaaagaacattttcattaatgcctcagcctgtgaatggatgtcaataaagatgagtgagaaggtatttcatatacaaaaa

SEQ ID NO: 54439 - DNA, 921 bp, Homo sapiens
  misc_feature (28)..(28): n is a, c, g, or t
  misc_feature (30)..(30): n is a, c, g, or t
gaggattccggggactggagggcagccngnagccaagatgcaacttctccaggagtgcttatgttacccaaagagaaacagatgcacaaagagaaggaatgagatgctcggggatattttatcaaggaaaccagcaaaccgtctttttcctgaagaccttttaagattaggacaagcagctgtttataaaagcagaacagtgttaagatttgaactgtaaagtaggatcatgctttgaagtatattctagctaaaagcaggggataaactagataaaacttggagactctaagacctgaccctgattaagtgggcctacaagtgagaatctgaagaacagctctctggctgaacatatcccttggatgttgttattaccagctgcctctagatttgagaacagtgctgagcatgcttttaaatgatctttgaggtactttaagctagctacacctgaaagcatacctagccctcatttctgtttgcttgaacaagagcctgaaaaagaagtctaaagaactttctagtgatatccttcagtcctgttctaaaaagaacctgtgttcttcaccgagttaaggaaatttcacaactccccaggggctaatgtggagttcattttcacttactgctgaatcaactgaagttcctttcagagtcttttcctagagtggaaaagtatctgagctcttcaacctactattcattagtgctgagagacaaaaatcatgttagagtctataatgtaatggagcataaaacatttaagttatgaatctgcataaaatgtgtaaaagatgaaaaaacatactttaatgtttgtcagtacttattgatcagtgaaagaacattttcattaatgcctcagcctgtgaatggatgtcaataaagatgagtgagaaggtatttcatatacaaaaa

SEQ ID NO: 54440 - DNA, 294 bp, Homo sapiens
ccacctccaccctctttcccaaggccttgagtgacggaggggacagaatggggtcggaggtggcgaggggcctccgaaggccagccccttcctctcccttcacacccttcactccccgctcagacccaggcttctgccccacgcccctcccctggcccagccaccagctgacttcctcggccggccccctcccctccactctgggattggtgccagggtgagaaggggacactggcactgaccgtgtctgggaattcccgcccaccgaggagctgaaaggagggggggtccccg

SEQ ID NO: 54441 - DNA, 366 bp, Homo sapiens
gacaagcactgatctaggactcattaagtttctaaaacaaaggttgcaaaaagtggcaagccacaaactaaatgtggtctattacattttttgtttggtctctacactgtttaaaattcttgaattatttgccaaaattaaaaggaggaaaagttcataaaaagagattaatttattgataaattgcatgattatataaaaataggctaacatttctgtatgacaacagtggagctgagtgacactgcttcctttacaacagaatgctacatgttccctgtgacagggttcattgcagtcctcttcatttacttatgttatctacctgaccctggtacgcatttgactttctaatctctgctgtca

SEQ ID NO: 54442 - DNA, 212 bp, Homo sapiens
cattctgtgtcaaagagtcaaaacatttcatttgtgggtttgttgcatatggagggtgctaatgcccaaagcttaggcaaagctgacagtaatctcatcccctgagctgggcattcgcatcttagcagcataggaatgggcgactggctttgttaagtcaacaaaacaggcaccacaataatcgttttccagattgggttggacatggcact

SEQ ID NO: 54443 - DNA, 448 bp, Homo sapiens
aaaaaattaaaaaactgttaagagcaattctagaaagacaatgaaagaaaaacaatgtgtgaagtaatggtggctgaaatttcccacagttaaagaaagggagctctctaaactgatatcttaacatgtcgtagtaaaactttagaacattaaagatgaataagaaaaaatctttactcctattgaggaaagaaaaaaaagattacctacaaaggaacaatagtaatattggctgtaataagataacggagcagcatcttcgtagtgccaaggaaaagtaactgccaatctgaaattttatgcccagctaaactattactcaagagtgaggggaaaaagttaaaacaccagaaacaaaggactcaaagattaacaaccatgagttcttgctgaaagaacttctgaaggatgtactccaagaaaaatgaaccttaaataacaagcctcc

SEQ ID NO: 54444 - DNA, 565 bp, Homo sapiens
  misc_feature (12)..(12): n is a, c, g, or t
  misc_feature (91)..(91): n is a, c, g, or t
  misc_feature (141)..(141): n is a, c, g, or t
  misc_feature (189)..(189): n is a, c, g, or t
  misc_feature (191)..(191): n is a, c, g, or t
ctagctgtgctncataacccactgggtgtcacttctagtccctcttggtgggcggagctgagacagatatgtacatatacacatacctttnctcagctctgagatatatatatataggggttctgtgtgtgtgtgtaaatnatgtgtgtgtgtgtgtataaatgtgtgtgtatgtgtgtgtgtgtgtananatgtgtgtgtcaactgcatataggtatgcaaagatagagaagtctatgaatgaatttgagaaggaacagctagagaagaaaaggatagcaggaaggatagccagagaagaaaataagagaaaccaaggaagtagatttcaaggaggagtgaccaactgtgtcaaagacacaccgacattagacacaccgacattagacacaccgacattagacacacagacattagacacaccgacattagacacaccgacattagacacaccgacattagacacaccgacattagacacaccgacattagacacaccgacattagacacaccgacattagacacaccgacattagacacaccgacattagacacaccgacatt

SEQ ID NO: 54445 - DNA, 240 bp, Homo sapiens
ctctgactatcatttcaccaaatgtgtaaacatactttgttatctatgtggctagtagggttgccagattgagcaagtaaaattataggacacccagttaattttggattttagaaaaataacaaatcaatgtttagtatagcatatttctattattgcatgtaacatacttatgcaaaaaagttatgtgttgtttatttcaatctatatgtagctatgcatccgtatttaacctcaaaa

SEQ ID NO: 54446 - DNA, 155 bp, Homo sapiens
gccaattgtgctaccagcctcttccttgcagtcctgggcttagcattcaggaccagtagtgggaagggtcctgggcagggcttcaggggtagggagttggagggttgcagttgaaggccactggatgagtgacagacccaggcagagagaggggt

SEQ ID NO: 54447 - DNA, 495 bp, Homo sapiens
gatgtttgaaaatgctatgtttactcgttcttgggttccaataaaggagaaacagggcacaggagtcggaaggactagtggcaatagtgatgaaaggacctccttatcatgctggcaatgttaattacccaggtgtaggaagccatacactgaggcggaagatcgcaagtcagagtggccggcaggcacaacctcctggcacaccagaggcaggtcttcaatacccactggtttccccaacaggctgcgtaagggaccctgagccacagtgagttggtcaaatgctcctgacagtgtggagaaaccaacagacaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctc

SEQ ID NO: 54448 - DNA, 2547 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccagggctccctgaccaccctgcctgtggaggtgacctgttaggtctcatgcccactcccccaggagcagctggcactgacagcctggggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagcccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaaccggccgcagcccccactgacctgcccatgtccagagggactggacagccagggcagggctttggggggcactagaagatgagggtgtcggctgtgaggcgggtggctggtataaataatatttatcttttcaaccaaaaaaaat

SEQ ID NO: 54449 - DNA, 2634 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccagggctccctgaccaccctgcctgtggaggtgacctgttaggtctcatgcccactcccccaggagcagctggcactgacagcctggggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagcccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaaccggccgcagcccccactgacctgcccatgtccagagggactggacagccagggcagggctttggggggcactagaagatgagggtgtcggctgtgaggcgggtggctggtataaataatatttatcttttcaaccaaaaaaaat

SEQ ID NO: 54450 - DNA, 1273 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggaggtgaggctgagccgaacaaggctgcccatatggaggggagtccagggtccccagcagagttttgtgcctgctacttggagtcagggagccagaggctaatgtcaaggccctgctctagtgaagctgactggggagctggagctgtcaacttggaaaaggcccatgagcaggcgccctcgagggcaggctggaccaatggggcactgggcaggctctgatggtgatgagatgggtccttgttccttccttccttctccctgtgctcatcgggcagccgcttgcactgggcatgggactgtcctgggggtgcaaagggagaccagactcggtcacaggagtcccacccttttccacaacacatgcctgagagatacatccagttccagccacagggctgtatgggaaccagggacgggatggaggtagcaatgcagtttgaaaaagcccttggaaagccttttaaaatgttaaatgtttttgagcagatattgcttacacagaactcagaaggtacaaatgggaatacaatgtcccctcccaccccgtccccagccactggattccctcccagaggcaaccattttgccaatttcacaagtgtccttccagagacattctccgcatacacgagtaattttgtatacgtattcttttttgtttttacctgaatgttgcatgttatacacactgtctacaccttgcttttttcatataatcatc

SEQ ID NO: 54451 - DNA, 2427 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccagggctccctgaccaccctgcctgtggaggtgacctgttaggtctcatgcccactcccccaggagcagctggcactgacagcctggggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagcccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaaccggccgcagcccccactgacctgcccatgtccagagggactggacagccagggcagggctttggggggcactagaagatgagggtgtcggctgtgaggcgggtggctggtataaataatatttatcttttcaaccaaaaaaaat

SEQ ID NO: 54452 - DNA, 2505 bp, Homo sapiens
ggggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccagggctccctgaccaccctgcctgtggaggtgacctgttaggtctcatgcccactcccccaggagcagctggcactgacagcctggggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagcccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaaccggccgcagcccccactgacctgcccatgtccagagggactggacagccagggcagggctttggggggcactagaagatgagggtgtcggctgtgaggcgggtggctggtataaataatatttatcttttcaaccaaaaaaaat

SEQ ID NO: 54453 - DNA, 438 bp, Homo sapiens
tacagtttagttagggcaataaaatatatcctggacaattaactctagagtaagttaagtgtgagttgtctggcccattccccagtacataggtattcaataaatgtttctgggttagtgcaatacttaagaaatacaagcatgtgttttaggagtttaggggagaaattgctttgtttatggggaagagaggtttcagagaagttcttttggaaaaagaaaaggctagatactgacttttcttaaatgccatgaaataatttcagagtcaggcatttctgactcttaagtcagaacccaattgttaagtcagaaattggggtagagaggatagtgtgagcattgattgctaaagtaggtgctttcacgtgtgttgatggttacttgtttgttaaatgaagtaattctcaaactttaatgtgtcataccagattctta

SEQ ID NO: 54454 - DNA, 532 bp, Homo sapiens
acgccccagctcttacatgaggccgggagcacaaggtcgccccttagattgccttggaggcctgagactgggctggagagacaggatggcatagtgaaagaaggggagcaccggccaaggagaaaaggaaccctaggctgcaggcccagccctgcttcttaccgcccctgcgcctttcagtaaatcacctcacctgtcagagcttcagttttctctttttgatggaaaggaatatgccatattctctctaaattttcttttggctctggaagtctgttactctattactcttctaaatgatgactgtctcaagccccatctcaccacaagtttaggactgcagtgacagcctttgattgcctttattccttactgcttttgtcgcctgtttttaaacaatctcttttaaatattaagcatcatattgttttggcttctgttatgagaaagatgaatattatggctgttttgaagttaagattcatttggtctaggtggcccaatatcagaagtataagttaactggtattaa

SEQ ID NO: 54455 - DNA, 325 bp, Homo sapiens
cctcctaacacctgttattgtctggctttttaattatagccattctagtgggtgtaaagtgcttattgtggttttaatttgcatttctctaatgagcaatgatgagcattttttaaatgtacttgttggccatttatatatcttctttgatgtgtttattttaaatcttttgcccattgggttgtcttactgagttgtaagaattttttgtatattctggatatgaatcctttatcagatatatgatttgcaaatattttctctcagtctgtggatttcttttcattttcttaatgacgtctttttgagggtaatagctttaaat

SEQ ID NO: 54456 - DNA, 819 bp, Homo sapiens
gcctccggtacttgcaagcctcgctcagtcttaagcaagaggggatggattcgcccgcagcactgagaatccaggggcaggcgggatggcgttcaggcgctgttgctagaaatctctgtctttactctgttttgaaggcagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatgaggctgggtgtgatggctcacacctgtaatcccagcactttgggaggccaaggtaggaaggattgctagaggccaagagttggagaacagcctgggcagcaaagcaagaccccgttttgtacaaaaaagaaaaaaaagaaaaaactaggtgtggtggtgcacacctatagtaccagctacttggcagaccaaggcaagaggatcacatgaggccaagagtttgagacaagcctgggcaacatagtgagacccctgtctttacaaaaaatttaaaaattagccaggcatggggtcatgcaccctatgtagtctcagctactggggaggctgaggcaggaggatcgcttgagcccaggagttggaggctgcagtgagctatgattgcaccactgcacttcggcctgagcaacagagcgagaccctgtctctaaaacgaacaaagggagagaattaagtgatttcatacatttaaagcacttgggccagttag

SEQ ID NO: 54457 - DNA, 1754 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54458 - DNA, 541 bp, Homo sapiens
agtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54459 - DNA, 1393 bp, Homo sapiens
gtgggggactgggagactcgtgctctgtaagcaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaataaatttgcctctatgtgttctacattaacccctttggtgctatgccttctagcacttctaggagcacatcatgcatgcctcatgctattaaataatatgcaaagactagcacatattcaaaaaatggccttaatgctgctccagggaattgggtgtgtggttgtgtatgtggagatgtgagtgagtgtggttgggagtaggggtgcatgtgcacacatgtgctttcccaagatccaggctgccttaaacatgactccatactgttacttggacacggatagaacacaaagaggtaggaaggcagaagctattaatttgtaaattgaacgaaggagatcaggttcacacccaaaacatatatatttcatctttccagaacatttttgtatatataaatatagtccagctattttcaatgctatacagtgaaatttataaatataacatgttgaatggcaatttttctcaagaaaaatgacagttcaaagcatttgccattgaattttttataaatacaaatgtagtcccataaacacactatcttataaattagaagcaaaattagtgccctgcaattttgatctttatattacacaggaattgcatgactgctcatttttaatgctaacatccattttgaatcttcatcaaactgtatatcttccttttccctggctatgtcattttatgtagaatttttattatacttctgaggatgctttattggtgaattacattaaatccatctagaaag

SEQ ID NO: 54460 - DNA, 1294 bp, Homo sapiens
agtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaataaatttgcctctatgtgttctacattaacccctttggtgctatgccttctagcacttctaggagcacatcatgcatgcctcatgctattaaataatatgcaaagactagcacatattcaaaaaatggccttaatgctgctccagggaattgggtgtgtggttgtgtatgtggagatgtgagtgagtgtggttgggagtaggggtgcatgtgcacacatgtgctttcccaagatccaggctgccttaaacatgactccatactgttacttggacacggatagaacacaaagaggtaggaaggcagaagctattaatttgtaaattgaacgaaggagatcaggttcacacccaaaacatatatatttcatctttccagaacatttttgtatatataaatatagtccagctattttcaatgctatacagtgaaatttataaatataacatgttgaatggcaatttttctcaagaaaaatgacagttcaaagcatttgccattgaattttttataaatacaaatgtagtcccataaacacactatcttataaattagaagcaaaattagtgccctgcaattttgatctttatattacacaggaattgcatgactgctcatttttaatgctaacatccattttgaatcttcatcaaactgtatatcttccttttccctggctatgtcattttatgtagaatttttattatacttctgaggatgctttattggtgaattacattaaatccatctagaaag

SEQ ID NO: 54461 - DNA, 675 bp, Homo sapiens
aacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagcgtgaaatttcacagttccgcgggttggaaagcat

SEQ ID NO: 54462 - DNA, 1886 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagtcgtttctggaataccagcccttctatcagaactggatggagacctgtggacacccctagtaagctgcagatttttcacagtggtcatttgacctccagagcaagccaataatttgtcacttcattaaactgaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54463 - DNA, 1373 bp, Homo sapiens
tttctagtaagattcaacattatgaaaatattttgaattaagcaatgacacatgaggctggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54464 - DNA, 1578 bp, Homo sapiens
tggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54465 - DNA, 1422 bp, Homo sapiens
aacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54466 - DNA, 1374 bp, Homo sapiens
aacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtcagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 54467 - DNA, 2507 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaataaatttgcctctatgtgttctacattaacccctttggtgctatgccttctagcacttctaggagcacatcatgcatgcctcatgctattaaataatatgcaaagactagcacatattcaaaaaatggccttaatgctgctccagggaattgggtgtgtggttgtgtatgtggagatgtgagtgagtgtggttgggagtaggggtgcatgtgcacacatgtgctttcccaagatccaggctgccttaaacatgactccatactgttacttggacacggatagaacacaaagaggtaggaaggcagaagctattaatttgtaaattgaacgaaggagatcaggttcacacccaaaacatatatatttcatctttccagaacatttttgtatatataaatatagtccagctattttcaatgctatacagtgaaatttataaatataacatgttgaatggcaatttttctcaagaaaaatgacagttcaaagcatttgccattgaattttttataaatacaaatgtagtcccataaacacactatcttataaattagaagcaaaattagtgccctgcaattttgatctttatattacacaggaattgcatgactgctcatttttaatgctaacatccattttgaatcttcatcaaactgtatatcttccttttccctggctatgtcattttatgtagaatttttattatacttctgaggatgctttattggtgaattacattaaatccatctagaaag

SEQ ID NO: 54468 - DNA, 1826 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcaga

SEQ ID NO: 54469 - DNA, 1192 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattaccccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgtt

SEQ ID NO: 54470 - DNA, 1505 bp, Homo sapiens
gaaattaagcagcatccaacacaggcctactcttacgacatgtgacttcactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccagggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaacttcagatgttctccaaggtcacacctagttctaatattctaagaacttaaatttagagtaaaaagaatggtctcactacttacacagtgatcttgagtatctttcttaaccattccccagactgcttcttcctcaatgaaaaggggttattaaaatatgcaacacatatctca

SEQ ID NO: 54471 - DNA, 303 bp, Homo sapiens
tttccctaaccttcctttttatttttttttccagaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttaggg

SEQ ID NO: 54472 - DNA, 590 bp, Homo sapiens
ctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtggtgagtgcgcgcgctggggcgggggctggtgccggggtgggctcactgcaccccagctgctgctgaccctcttctgggtcgccacgtatgggactagaaggccgtcccatgccccactcccagacgcagcccttcggagtctcttgcgttctgggggcagtcgcacggcgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcag

SEQ ID NO: 54473 - DNA, 1759 bp, Homo sapiens
ctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaacagagt

SEQ ID NO: 54474 - DNA, 1681 bp, Homo sapiens
ctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaacagagt

SEQ ID NO: 54475 - DNA, 1783 bp, Homo sapiens
ctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaacagagt

SEQ ID NO: 54476 - DNA, 1533 bp, Homo sapiens
ggtcgagcgcccggtatgagagcgcttagagatcgggaaagaactccagttagtgtgggacgagccccacctgactccggggaatgactctctgcttccttcctcctgttgtgtcactgcagcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttagagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaacagagt

SEQ ID NO: 54477 - DNA, 1652 bp, Homo sapiens
ctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatcctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaacagagt

SEQ ID NO: 54478 - DNA, 3697 bp, Homo sapiens
  misc_feature (172)..(172): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54479 - DNA, 5297 bp, Homo sapiens
  misc_feature (172)..(172): n is a, c, g, or t
  misc_feature (1578)..(1578): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggtagagtatcccggggaggctggggctgtagtgggccagcagtcgggccagagtccagctcagcaactccgggttacaggcagcccaggcgggcctagccaccggcagctgcactcagaggccactgtgtcctggctgagctcatctgcctgcctgctgggggagaaagcggaaggaggagaggcagatctggggagtggcagcgaggtcccgggcacccccctggccagcaggcacccttccgttgtccgagctgggttgccaccgcctccttttcctgggattcccggacaccctccaagggaaccaagggaacagctctgggtccagctgccccaggaaggactgtgcgccccttccccacaggggtcaagtatcccttccagcaacagccgtttcctgggcaccagcctgcatgcccagtgctgatgcagggatgtggccatgaatgactctgggaaagaatcattcttagcaatggactttgtcagggtccaagaaaggagtggccagccagccccgccccgcctgcaggaggcacttctcatcccgggaactgtgccccatcagggagccgaggctgttcagcctctttgtgacccggggctgggttggcccgagccacnaatgaggggatacgctggtccctggctccccaagggaggggctgctgagctttgggaggcctcatgaaaatccagcttaaggccatcaaaagacaaaatgacaacacatttagttatagatcaaattggcttctattcatgattcgtgaatccggacagcctccattctacaaaatggagtgagagctcccaccaggcagtggcagagcagggggttcataaggcagaaaggaggaaacagaaaaataggaaacaccaaaccgcctaataccggatcgctgcagactgcttttttctaagcggactgcttttttctaaggggtaaggcagaggggacctgatgatgccggctcaggtggactggaatctcctgcttcccggagaaactggtctgtggttttgggctctgtctgcttccttaaagcttcggtttgatgatgtggcatttggcatgagtgcctccattttggtttggtctggtctgttggggcctagtacaggagctcagttcaaaatcacagcctctcatcatgtttgtttaatgaagctacactgcaggagatcagaatcggagaccctgcggtattgggcctgtgggtcccctgaagttggcctagtgatccccgccttctggctgccctgatgggggtcccccaggccctctacccaccatgttcagtccctctgtcaccacatccctgtcctcagttgggtctcagggtgatgtccttgtctccccaacacccaccttggatcaaggccccttcaggcccctgccccaggggtctcctccctgagccctcctctggtacatccgtcctccatggatactgagcacttcccggggtcccagtgcttgaattctcccgacagtggtatgggtgccacaggcagtgcccaattttacagatgggaaacgtgaatacaaagaggtcaagcaacctgcccaaggtctccccactcacacatgtggttgctgcagtttaaacccaggtcattgggcccccagaccatgccatgctgggaggatgctcttagaaggcccatggtgtagatgaggaaactgaggcaggaagaatgagagaacgggcagagcctccgtttccctggaatccaacccacttgataggccagggtgtgaacgagcagggagtccctgcccagggacggtccctgctgtgaggttgggggcagcggctcggccagccattcactccctgtgatatgtcagccccgttcctccccactctgttcccggagcctgtgggcacccacagcgagcacccaggctggcatagtgcccagcacatgggcacctgagtattgtttttagaggcccgtggccttgagaggaagtggctggtcctgccctggcccccaggccagaggaaacagccgctatcttcatcaccaaatgatgtggcaactcccccccaccccagaagctgcaggtctgggccaaatgcacctcaacctgtgatggggggccacgccccagagacccttgggcccatcagcccctggacctcagtggctcagccgcaggaggcaagaggcagtctcagaccccacaacctaagcagtgtggggagtggcagcaatagtgaggagggaggccgaggaaatggaatccaaacagcaagagacctcccctcaccggtcacccctcccacagctggcctaccggagtccacccagccttgggtctgccgtccaggccccagcccagtgtcccttcccccaaggacttggctgcccatccccaggggactgtgagggaggtgggagctgaggtggatagccttctgctcttctggatttgggttttccaatgtgaggagctgggtggtatcaggcaagctctggccctctctgagcctcagcctccatctccttcagtggggtgaatagtggtccctcagtgggcggccgtggtggtgaaatgagcgagggcaggcatggggatcacactccttacaacctcacactgtgggatgagtgccgcgggggtgggcttgggggaccccagcccagtgcctgattcaggagttccctattctgtgtgtccacaatggctgcccagcaccctcgggagataacaggcccaggatccccccaatctcaggcagaaggcggccttggcttctccgcttgccagggtcctgccctgggcactccctgggggcctcagtccagagtgagtgacccgtaggggcaatgccagggctggttgccctgtgggagagatgtgtcctgtggccctggtgagttggtttcagcgttgctaggagggttgctggaatgttccctgcagaactccatcccccacagagctcccggcccacagtccaccattcacgttacgtgccttgcatttttgtggtttctgcagagattcttacaaagggtgagagaggcacaggcgtggtttgcctttgaccactggcagaagtctgaaggtgagagtagaatggagaaggacccaggagagtgcggagttgagggagataaatatttgcaggctacttagcaaaacacccagagctgacctttgtcgagtactttctgtgggcacaacagcaaatgttttatgcagcgtgatgtcatttaatcctcacaatgacaccaggtgccattagcatccccatttcacagatgaggaaaccgaggcagagaaggtgagtgatttgcccaaggtcccacaaccagtaagaggcagagcccggagacaggcctgatggtggctcgagaggctcgttcttggctcctgggtctcagtcctgctcccgtgacgagccatcccctatggggaccatggtgcctgtcctgtgtgcgggccactgcccagcttctcccaatcagagcaggaagatggtgggttcagcctggccccacaatcactccagctgagggctggcctggggctcctgaccaggctctcagtagcacactggtccagcagggccatcctgcagaccggagcaggtcccgccctcaaggtggccacttaacaatcacccacagccttgcgctcaccgatgctgggccctgggctcagaaccgactgtgtggtctcatcattagctggcaggtgccatcattacaccggtaacatgagaggcttcaagcactaggtctcaaataagtaggcacagaggggcctgcctcccagtctaatgagggggaaataagggagatgtggacagggttgggaggtgggtagagtgtaaccagacatttatcacatggcacaactcagaacgctggggagcagagtcaaggggccactgtgacagtggatgagggcataatctgggtgggctgcctggaggaagcatcagccaagctgagatctggaggaaagggactcggagagggaaggaggaaagggtcaccacgggtccttggcaccaggccgaggaacgagtgcgtcagagtgctcctccgatgaacttcaagtaaacaggcagggctcgggggaatgtctaggcccctaccctgcctgccagctctggctggcaccagcacggaggcaggaacgccctctcccttcggctctgattccacctcctgccttcccatcccagctgcaggagcggggccctacaaaggcagcagtagcccagaacattcaacctggtccctccctctggacctggtcacccccctgtccccaccctcagcaggcagcatctgcccagcgtcacgtgcaccctctc

SEQ ID NO: 54480 - DNA, 773 bp, Homo sapiens
tctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagatcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54481 - DNA, 3586 bp, Homo sapiens
  misc_feature (172)..(172): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54482 - DNA, 2736 bp, Homo sapiens
acacagaggacaggggctctgcagtccttcacccccaccctaactatctaatcacgggccaccggtgtgggcatggtccagaagacctcaccgccctcccaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54483 - DNA, 4341 bp, Homo sapiens
  misc_feature (172)..(172): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaaaaaaaaaaaaacaacaatcaaccacataagaaatacaatagacaaaaaaaaacaaacaaataataaaacaaaaaaaaaacagacggcgccccaccccaaaataagcctccaccctgaggcccacacatctcgacactccaccgatattagtcagacaaaaatggggagcgcgaccccctaaaagcgcagcgcgacgcaacacaaatacgcacaccggacaccgcggccccgccggagatcgacacaacagcgcctacctaccgtgacgggtgagaacaaaccagcggccaaccacgggcgggcaaccacaggagagaagaaacaagcccccatctcacacgctcgcgatggacgagtgacgcccacatgtgtcggcggacgcaacacgatccacaccaaggaggcggacgcagaaacgaagcaaccgaccgcagaggagaaaaacaacaaacacagagcaactcaccagagcgacgggcaccccagggcggcatccaaaaccaacaaacgcccacgccgagcaacagcaccgacagccgcgcggggacaaaacaacaaggatgacaccacaacgaaggagaagcatgcaagactgaggaaggaaaaccacactcaaccgcgcgaggcaggaaaacgcatagcaa

SEQ ID NO: 54484 - DNA, 2654 bp, Homo sapiens
acacagaggacaggggctctgcagtccttcacccccaccctaactatctaatcacgggccaccggtgtgggcatggtccagaagacctcaccgccctcccaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54485 - DNA, 2782 bp, Homo sapiens
  misc_feature (172)..(172): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54486 - DNA, 2552 bp, Homo sapiens
  misc_feature (172)..(172): n is a, c, g, or t
aaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgngtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggggacacgttgcagctccggcaccctcaagaggctgcttcttcctctggttttctctcctgcttagctctccttagcgtccaacatgggagccaggtggtgcttgg

SEQ ID NO: 54487 - DNA, 1800 bp, Homo sapiens
acttgttcagtgtcattttaatattttgaacatattaacttttaaagtacttgtctgcgacttccaacatttgtatcaattcttagatctgttttgattgcttgttttgtctggctgtgtcacactttcttgtctggacacccagtaatcttttattgtgtgctggacattactgatgctgttgtgacagtctggattttgtcttccttgaggagtgtcaagtcttgtgctggcaggcagttaatttactcacagttctgcttgatcctgttgtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54488 - DNA, 1061 bp, Homo sapiens
gcccagcaaaggcaaaggagccctggaaggaaccacagagcccaggaagcactgtgccaggatggggcaggggtgagagtagagaaggcacagtggctcctgccggctttaatcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54489 - DNA, 1486 bp, Homo sapiens
tctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttgggggtatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgcacagcaaggccgggcatggtggctcacacctgtagtcccagcactttgggaggccgaggtgggcggatcgcttgaggccaggagttcaagaccatcctggccaacatggcgaaaccccgtctctactaacaatacaaaaattagctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54490 - DNA, 1431 bp, Homo sapiens
tctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttgggggtatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgcacagcaaggccgggcatggtggctcacacctgtagtcccagcactttgggaggccgaggtgggcggatcgcttgaggccaggagttcaagaccatcctggccaacatggcgaaaccccgtctctactaacaatacaaaaattagctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 54491 - DNA, 243 bp, Homo sapiens
tgtcttggcagtgtaaaggaacaagatggatggaaaaggtgtatagtggcagggtgtgcctttgtttccttattgaacagggcaccttgccatttgcagtatatggaaaattgaagaaatacagtctacttccgcaaaaggcacatacaaagggctctgtttagaccagagatcagcaaactatggtccgtgggccaaatacagcccagcacctgttttttgtttgttattttaagtgtataa

SEQ ID NO: 54492 - DNA, 742 bp, Homo sapiens
tgggaaaaggagagtttggcttaagtacaggatgccagcaggggaccaggagagaaagctagaaaggaagagaggatcacactgcaggcagccacgggaactagcctctaccttagaggatgaagaggagccactgaaggtctttgagcaaatcaatgttacaatatcactgagttgggaggctttatatacacttggagccttatcaataatttatcttttcagtttacaagcactctcaagtatgtatttaatcattctttaatgctttattaatggctcatctccttattagagcagtcaagccctggatgagacacatcatgtcccacatttgaccacacacacagtaggctagcttgaaattcagacttaaagctgcatggcttttaacagcctgtcacacacctccttcaactactaacaacagagaaaatatgaaaaactttaatttcctctgtcttcatccccagtgtctatttacaggcgctgatgaagaaaagaagtggcaggaagcatgagccagaaaaaaaaaaaaaaaggcctgaatcaagaagtatctggattcctcctgaaaaagtgagcataaaccatactgctagattttggaaatattcactaaagctaaaacatggctcgctattcttcaattattttaaccctcctcttcaagaaggaaatcattactataacttaagcttctagatttgtaccagtttttagctgctctgtaagtttgttt

SEQ ID NO: 54493 - DNA, 180 bp, Homo sapiens
cagcagcagaggaaaataatttattctttcttttcatctctttgtaagagcaaagaagactttcccaaaagcctccagcggattttctcacatctcgaattggtcagaactctatcacatgcctagatcaagcactggcaaggggaagggagccccatgatccattagtgtttcacccgt

SEQ ID NO: 54494 - DNA, 425 bp, Homo sapiens
  misc_feature (14)..(14): n is a, c, g, or t
  misc_feature (22)..(22): n is a, c, g, or t
  misc_feature (54)..(54): n is a, c, g, or t
taacggactcaacntatagggnaattttggccctcgaggcccaagaatttcggncacgaggagagagattcaataccctgtctctacaaaaaatacgtttgtttgtttgcttgtttgtttgtttgtttgtttgtttataaagatagttataaaactccacataaacttggaggttaagtaacaaactgagaacacttctataccaaccacctacatacacacacacacacacacacacacacacacatatacacacacacacacaaagttagccgggtgtgttagtgtgtgccagtggtcccagctcctcgggaggctgaagtgggaggatcctctgagcctgggagatcgaggttgcagtgagccatgatcatgtcactgcactccagcttgggtgacacagagagatcttgtcttaaaaaaaa

SEQ ID NO: 54495 - DNA, 383 bp, Homo sapiens
gcgattctcatgtctcagcctcatgagtaactgggattacaggtgcatgccaccatgcccaactaatttttgtatttttagtagagatggggtttcacctcgctggccaggctggtctcaaacccttgacttcaagtgatccacccacctcaacctcccaaagtgctgggatgacgggcatgagccaccatgcccagccgcatttgtttttataatacaggattcccaaaggagcactttaaagtctcttgcatgtaaaacagtaagcatcttgagaatacaaatgatgcaacctgattttatttaagtgctttttataattgttttaaatccacctagagtatacagaatgtgaatatcaagaaacccataaccgtgacttt

SEQ ID NO: 54496 - DNA, 6320 bp, Homo sapiens
  misc_feature (2261)..(2261): n is a, c, g, or t
  misc_feature (3413)..(3413): n is a, c, g, or t
  misc_feature (3438)..(3438): n is a, c, g, or t
  misc_feature (5246)..(5246): n is a, c, g, or t
  misc_feature (5390)..(5390): n is a, c, g, or t
  misc_feature (6246)..(6246): n is a, c, g, or t
  misc_feature (6262)..(6262): n is a, c, g, or t
  misc_feature (6266)..(6266): n is a, c, g, or t
  misc_feature (6271)..(6271): n is a, c, g, or t
ggatcgtggggaggtctggagtttgcagagcccacagcttcctttgcttttattaaagaatgggcaaggaccaggcttatagtaggtgctgacgttccgagtagaaactccttaatgagtgaatgcatgagtgaaggaatgaaggcagctggtttctgaacctggatgtagccatttgacaaactgcgcgcagtggctgagggggaaagccccgccccgcggagccccgcccccaggccgcacgccctcgcgtctcctagcaaccgccaaacgtagctgagtggctgggcctgcggccctccctgcaccggcggacgctcctctcagtcttggagtctcttcgcccaggtggctgtggatccggtacgggagttgccgccgcggtccaactccccgctgccgcccagcgcatccgctcgcaggagcgccggcggccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggacttnatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccnggtttaagcaattctcctgcctcancctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgcttagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcagtttgggacgggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacantggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccnttttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccatttcgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccnggaggcgtagctagcngtgngccangaccgtgccactgtactccagcctgggcagcagagcaagactctgtctc

SEQ ID NO: 54497 - DNA, 6023 bp, Homo sapiens
  misc_feature (1964)..(1964): n is a, c, g, or t
  misc_feature (3116)..(3116): n is a, c, g, or t
  misc_feature (3141)..(3141): n is a, c, g, or t
  misc_feature (4949)..(4949): n is a, c, g, or t
  misc_feature (5093)..(5093): n is a, c, g, or t
  misc_feature (5949)..(5949): n is a, c, g, or t
  misc_feature (5965)..(5965): n is a, c, g, or t
  misc_feature (5969)..(5969): n is a, c, g, or t
  misc_feature (5974)..(5974): n is a, c, g, or t
acaagtagtacttcacatcttgatagaccttgctttgttttgttttcatctgcttacttgaactagcccaccattatgatttcaacttctcctggtattctgtcgatggtgtaagtttcttgtatgggttggaaccccgagagcgcaccaacagacaacacgaggcggtgtggagcaacatgctgtttcaatgaacgccttggtgcaggccggctgaggcctaaaatggcgtcagccccaagtgaggacggggcaaaggttttatagtctcctgtaaacaggaagtgtcctagtctggcgtaactgctacgctgtacccggatggcctctttctcatcttcatgtcttccggccagggtaggtgtattccagccggctctcctcctgcttctgctattttgctggtgcacgctgctgacgtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggacttnatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccnggtttaagcaattctcctgcctcancctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgcttagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcagtttgggacgggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacantggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccnttttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccatttcgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccnggaggcgtagctagcngtgngccangaccgtgccactgtactccagcctgggcagcagagcaagactctgtctc

SEQ ID NO: 54498 - DNA, 5130 bp, Homo sapiens
  misc_feature (1071)..(1071): n is a, c, g, or t
  misc_feature (2223)..(2223): n is a, c, g, or t
  misc_feature (2248)..(2248): n is a, c, g, or t
  misc_feature (4056)..(4056): n is a, c, g, or t
  misc_feature (4200)..(4200): n is a, c, g, or t
  misc_feature (5056)..(5056): n is a, c, g, or t
  misc_feature (5072)..(5072): n is a, c, g, or t
  misc_feature (5076)..(5076): n is a, c, g, or t
  misc_feature (5081)..(5081): n is a, c, g, or t
ggatcgtggggaggtctggagtttgcagagcccacagcttcctttgcttttattaaagaatgggcaaggaccaggcttatagtaggtgctgacgttccgagtagaaactccttaatgagtgaatgcatgagtgaaggaatgaaggcagctggtttctgaacctggatgtagccatttgacaaactgcgcgcagtggctgagggggaaagccccgccccgcggagccccgcccccaggccgcacgccctcgcgtctcctagcaaccgccaaacgtagctgagtggctgggcctgcggccctccctgcaccggcggacgctcctctcagtcttggagtctcttcgcccaggtggctgtggatccggtacgggagttgccgccgcggtccaactccccgctgccgcccagcgcatccgctcgcagctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggacttnatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccnggtttaagcaattctcctgcctcancctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgcttagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcagtttgggacgggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacantggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccnttttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccatttcgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccnggaggcgtagctagcngtgngccangaccgtgccactgtactccagcctgggcagcagagcaagactctgtctc

SEQ ID NO: 54499 - DNA, 357 bp, Homo sapiens
ggtatgaattttatcataaattaagtaactctacattccattaactctctttttaaatagttcaaatgggggggacagtaattttttttaatacttatgaagtgttacctcaaaataatattgcccatggatatcaaatcagtctgaatgaacataactgaaaaatattcagaatgcttgaaatgacttagaagtaatctttaagagctaaccctaggggcccagtcctcctttcatagaggtgagctccttagctgaaatacatctctaaaagaccttctgtgaaaagtgagaggtgcaaaagttcctgaatgaccaaataccctgctgccaaaacgaaaagcaatttcatttaaa

SEQ ID NO: 54500 - DNA, 458 bp, Homo sapiens
acattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggg

SEQ ID NO: 54501 - DNA, 252 bp, Homo sapiens
ctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagt

SEQ ID NO: 54502 - DNA, 590 bp, Homo sapiens
aaactggcttgccttcatcatctctgcagggatcagtaaagattagaaatggattatttaccttgttatacaaatacacctcctccctacacccaagaattgagaggaagatgagctgttcctgtgttaacgcctgaatcaatcccattatctgcatttctgtgtgtggttagcgctccagcagcctaaggcgggagctggaaatgacagccttggagacgaggaaggctccagggaggacggagaggaacacctgctgaagaataagacgggcggcaccagccgggctgatttggggaacggaaggtaacagaggtgatgcttctatcgctttacaggtctggaaagacggatgcctcaccaactgggtttctgatccgagaaaaattgaaagacaaacatggctgggggaagcaaaacgctgacacacaattcaggtggcccagcagtgctgacctgcaatccaccccaccccaaggcagccctttcaatccaaagtggacagagtgggccttatcccagaatcactcaggaagcttcttcaaacatatgactgccacacccgcccccaaggttcagaaacatcttcg

SEQ ID NO: 54503 - DNA, 152 bp, Homo sapiens
tcgtccaagtaatgaaggctataaaacatcttcagtaagtccccagattgtggattttgcggttgtttgtgatctgcacgtcttaactacctctgagtcttagtaatctgtcactgtccagcctagctcatgtgccccctttcctgctctag

SEQ ID NO: 54504 - DNA, 163 bp, Homo sapiens
gaaataagaaacagcttgtatataactaatgctttgagggagaaattcaaatggctatgaaaaaatatttataattcaatgataataaaaatcttacacgttaaaacttgagaatgtagttaaagcaatacttggacataaacttagcacatattagtaaaga

SEQ ID NO: 54505 - DNA, 830 bp, Homo sapiens
cccttagtgggtggggggggcgattgaattcccacagtgagtccagcccaccgaagctcagaggattcctaaccttcctcttcagagagcctcagaagtacaatgctgattatgatctgtcagctcagcaaggggcagacaccctggccttcatgtctctcctggaggagaagttgatcccggtgctggtacatactttttggatagacaccaagaactacgtagaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctggctcaggctctggataggaggtccctgagacagatactggccctggtgacagtggggctgtgcgtggggccagagccttctcagaggtacaaaagggtagggtgggagggcagccaggcacaggaagggcctgaagagctgtggggcactgagtgtgccctttatgcagccctgggatagagccctattcagggccaggctggcgccacctggggatctctccccataccaggtctagaactgtgtgtcctgtccttccctggtggccgcctgctgcccagagcccacctcc

SEQ ID NO: 54506 - DNA, 378 bp, Homo sapiens
ctgaattggaggtggggatgaagtcaacagttctgcccatatcaatgaaagaaggttctgagtgaaatgcagggttgaacaagcagaaaagcatcccagtgctctttaaatgtggttgcacagtagggatccttctctaggagataatgagaagatgttgtcagatctgctttgaatcagatgtttatttacttttattctttcttaaggaatttatgaaatcactgcactctcatcaatttgctctccttctctaaactcctaatgatatttctcatgacagattaaaaacagaattttggaagccctagtcacatgccaaataaggtttcttacctgagagagttatccgcagtttcagatgccaaagggaaactc

SEQ ID NO: 54507 - DNA, 178 bp, Homo sapiens
aagtgagattttgagaagttaagtgatttctggaaggttattcaactaatagagtggcagaggtgggaatccaggtggctggttttagagcttgagtcctggccctgtgctatattggggagctgatgtatttaaaaaaatagcagggaatttcagcctttcctgttgagcctcttgg

SEQ ID NO: 54508 - DNA, 615 bp, Homo sapiens
gttcagtattttttcccttacacgattgcttggcaaaccccccaaactgtgtgtttcctctgctgtcacaccacaataacagtcatcaacacagaagatgacttaatgtgaccaaatgttgggggagttttccctgcaccccaagcagcagacactggctgggtgtcctctaactcagttccgatgctctctacctggggacagcgtcagatccacagactgagggctcagtcccacaagaccgctccctccttcccaccagcgcaggtccaggcctctagaacttctgacctactggcttccaattagggttcccacaacctcctctttgggtttgattaatttcctagagcggctcacagaactcagggaaacacttgtgtttaggggtttattacgagggattttctttaaaggagacaggtaaacagccagatgaagagatacagagggtgaggtctggaagggtcccaagcgcaggagcttctgtcctcatggaggtggcgcggcgcctcccggcgtgtggatgagttcttaccttcctattgggccctgtgtgtttagcaatccagaagctctctgaacccagtccttttaggtttttatggaggcttc

SEQ ID NO: 54509 - DNA, 725 bp, Homo sapiens
atggaccagaggggttacctgtgctctaacacagggcaggtgcagaagtgtgggctgcaaaaccagactgaagcacagcccaggaagacttggaatgctgccactgactccctggggtgcaaggcttgggcaggtggtgctatctattaagcatgcctccaagagctgaatctagaaaccagaagtataagcatgtattcttctagatcagtagtcaagttagaaaaactaaatgcccatcaatccctggggtgaagcataaaaaatgcagaataaggtcaagtcttacagacagcagcagaggaccggcggagaagaagtaagtgacaagagggaagagcccaggccacccacccagttcacagatccagactttctgaatggaaaacgcctgaccaaagccctcacacagccagcttcagagtgggaacctgggccccgcactgcccaaggcccctcggatgcaatggtcgagagaatgcaagcctctgaaattcctgcctagggctcctctgaagacccaggaactcccaagaacctggtgaaacacctcttagaggtcagccggcaagtgcgggccaccccgaatccaccccgggtccatcccttgtgccaacacatggcattccgtgggcagatcctgctctccactggggtgctctggtctggggccccagcatgattttccccagtagataaccagccccacaagaatggctttatac

SEQ ID NO: 54510 - DNA, 383 bp, Homo sapiens
ttttgtgtgctctctttataaaatcatttacattttttgtaggttgtttgcaagaaacatttagtgaaacatttgaaaatccattttattggtttgcttttcaaatatctgtagccttgtttcttaagtagaacccccgtctttttctttgtctttttctctttgttgatgcatcatcatcagttgttcagctgtttctgctccctcattttttcccttgttccagtgagactcaaagaaccatgaacttttgtgcccctttgtcttccctttcttttttcttttttaacaactaaggggtaatcacagaacaaccaaccattgtaaagtacaattgtaaagtggcatttagtacattcatgatgttgtacaactaccccttc

SEQ ID NO: 54511 - DNA, 402 bp, Homo sapiens
aaagaattgaagccccttcttaccacattgacctcatcttacgccattgtcttttctcacttctatgctgtagccacaccagctgtttctattcctgaaaccgggtctctgtaattgctgttccctttgactggagtgcttttcccccatggtcttctcatggctggcgtcttctctgcaggtctttgctgattctacctcttcaaagaggctttcgctggttgtccttactcataacgtagatcccactcctccaccgtcattccctgtatcattaccctgcttcatgtttcccccaagtgttgatgggtgtctgagatctgatgcttatttgtatgtttgcccactgatggcagggacctttcctttctggttcaccatcctattcccagtgcctggaac

SEQ ID NO: 54512 - DNA, 431 bp, Homo sapiens
tggggttggcttcagagagcactaggcaccatagaaatggcagcttcacagcttccttccttactccagccaggcaccgctgccttggcccaggcctgtggaatgttccagaagctaaaatgccctttgtctgggccttacccttccctggaacacaatggcttgtgcttgaagggctcggggtttgtgattcctcaagtaagccaaagaatcaacagcttccggggctgcccctcagcggctcctatccacggttatttttagtcgcatttaatttggcagccaggagcacttttgatttcacaatgattagttagagcttgtgtgtgcgctgtttttcttcttaccacccgcctgtctcccccaaggggactgggtgttgttttgacttttatgtgttacaataaaaactttcattgtagcaaaatgtt

SEQ ID NO: 54513 - DNA, 365 bp, Homo sapiens
tgtatactcatgctatatatgcacttatgcacaaatgcctggttgccattgtgtctgcctgtattcttggtcacatttggataccattttgttctaaaggcaaaaatatttagcagtttctaaatgaggattacatcctggtttttcaatatattcatggagggtttaagaacattgtagcaaccttcctggcaaattaaaatggcgggaaagattgagctttaaagtccgtggatttgtaggccaccagaaagctatctttattgttgacaatatataaaaactgaggtgaccccacatcatacagcccttgattattgagtgggccaaaagtaggaggaaaaagcttcattttaatgcaactt

SEQ ID NO: 54514 - DNA, 265 bp, Homo sapiens
aaatatctggagcaaaccctaatgttatattggcttcatgatacatacattagcagaatgtatgagttttcactgtggaacctaaattaaaggatattgaaaatgttggtctagtccaactagttttattcttaagcactttaaccatcttctgtagtagtggttctcaaacttcagtgtgaggagcttgttaaaaatgaaagctgcagggtcacacacactaagattcattagtttgagagcatgagtgatggaaatgagtagt

SEQ ID NO: 54515 - DNA, 528 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttcgtcgacgcggccgcgaatttagtagttgtagtcgacccgggaattct

SEQ ID NO: 54516 - DNA, 7133 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54517 - DNA, 6668 bp, Homo sapiens
ctcacaatgcaggcgctccagctctgacacgtgcacttctttattggaaaagaataaagcagtcactgatgtggcaggggcaggacacgagcagctgccgtcctcctcccagcgtgcctggcatggtcgcaggggagcgggtgcctggagtcccggtgacaccacggggcacactgagggagctgaggagccggggccgcgcagcctcctggatgctcagcggatcgtgtacttgtcccacttcttttcagggtcgtagggttcccagcggctggcgggaaagatgtgcttgttcttctcgtaccagctcctcagcaccaccttgcctgcatgggactcatccttctccacagtggcgtcactgagcaaccgcacatcgtcatgaacatcaaagttgaagagtggtccactcttcccccgtgccttggtgacgatgaagtcgtagaagctgtgatggtgagggatgatcaagtcctccttgatgtacatgagctgctccacccctgcggacctcagctcactgaagtctttccgaaggatctcgagcgccttctgcaggaactgctgcatggtgttgccctttctcatcttgactgtccgccggtgcccagagccatcccagtagctgaaggtgatctcgatctcctcactcttgatcttctcctgcttggcttcccactcctgccgcagctcttcccgaagccgattctcctcctcctcacggtctcgatcaggcaagaagcttgtgtcaacgtctgggttcttccccagttttctcttcttcgtggtgatctcttccctttccatctcctcctcatacatggccgcctcctcttcctcctcgcctccctcttcttcctcctccagggtgaaggacaggctggagatcttccgcttggcttccttcttacgctccttctctcgaagcttctccagcttcatctgcagctccttggactgctccttcttggccagctgcttctcccgctccttcaccagagcctcctgcttggccttcatgtcattcagggtcacgagacccacggtgctggacttgagctctgcctcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54518 - DNA, 7839 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggtaggagacacatggcacgaggtctgatgtgtcagctcctcaatgattggcctggtctgtgtgttcagaaagtgaaggcaacagtaagtgtggctgcatgggttgggaggaagattaactcaagcgtcgttcagcagtttagtgtgcactgtgtgtcaagcaatgctctcagcactggcggttcaggagtgaccacaacaaagctttgttctataaagtccatgacctagtggcaggtgctgttaagagctgtgaaaacacacacacacacacacacacacacacacacacacacacagtaaaggaataaaagaatggccactccataagcaaagcagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttgaaagaggacaacttgggagggtctcaccaaagaggtgacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54519 - DNA, 6422 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctatatcaaaaaagaaatcctatgtcatagggggcacgctttcacgctcgtgaaccctgcatcctaaaagaaatggagtcatgtaacttttgcattgcattcaaggatcag

SEQ ID NO: 54520 - DNA, 2830 bp, Homo sapiens
cctgtactgccctggggagtatagggatgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54521 - DNA, 1237 bp, Homo sapiens
catgcagaagggggtggagaaagaagactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54522 - DNA, 2616 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggtaagtcagcgcgggcggggcggcaggctgggctctggcaaagtggtctggcctccatcagtctcttcctcgaccctgcggggacccgcttcctccctactcggggcctgggagcggaaaaagtttgggcagccgggacactcctgggcgccaggagccacgtccgctaagcacagccggcgagtgcgcgcgggcggggagccgaggtcgcgctccgccgggcgccctccctccctgagctccggcacgcgctcacgctctctcccccagtccctttttccctgttactggaggggcgggtcaccccgcaggtagtcagggattgctgcgcccacgtgggagggagcccccttctgcagcgcgagttccggcgagagcacgtggagagaatcgtggctgcgggaggctgctccgctgccgcgtggggccgccgggggccgtccgcgctcgcggaccgcgtgtaggagacgagcggttcccttctccttccccgcggccctgcgggggtgggctcgaggagaagctgacccgggaaggagtaggaaaggggcagaggaactccgcccgccgcgccccctccccggaactgtggcgcccg

SEQ ID NO: 54523 - DNA, 2537 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggtaagtcagcgcgggcggggcggcaggctgggctctggcaaagtggtctggcctccatcagtctcttcctcgaccctgcggggacccgcttcctccctactcggggcctgggagcggaaaaaccgaggtcgcgctccgccgggcgccctccctccctgagctccggcacgcgctcacgctctctcccccagtccctttttccctgttactggaggggcgggtcaccccgcaggtagtcagggattgctgcgcccacgtgggagggagcccccttctgcagcgcgagttccggcgagagcacgtggagagaatcgtggctgcgggaggctgctccgctgccgcgtggggccgccgggggccgtccgcgctcgcggaccgcgtgtaggagacgagcggttcccttctccttccccgcggccctgcgggggtgggctcgaggagaagctgacccgggaaggagtaggaaaggggcagaggaactccgcccgccgcgccccctccccggaactgtggcgcccg

SEQ ID NO: 54524 - DNA, 1308 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccaccctcggccgatttaaacccagcatcgtactagcgg

SEQ ID NO: 54525 - DNA, 7079 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattagctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54526 - DNA, 6976 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatgtccctattaagcctagttgtactgcaccagccaatcc

SEQ ID NO: 54527 - DNA, 3688 bp, Homo sapiens
aggtgactctcaggatcttagggctactccacacacagtaaaggaataaaagaatggccactccataagcaaagcagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttgaaagaggacaacttgggagggtctcaccaaagaggtgacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgaagtagatctgcttcttcatcttgacatgtaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaagtgatt

SEQ ID NO: 54528 - DNA, 4913 bp, Homo sapiens
attcgcggccgcgtcgacttttttttttttggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggggcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaata

SEQ ID NO: 54529 - DNA, 147 bp, Homo sapiens
cagtgatacgaacatttcttgggggttcacaagcatcaattgccaagactggttcagaaggatggctaggttttccaactccagcagcattttctgcatacaccctgaattcataaataagtccagcactgattgttgtgactttga

SEQ ID NO: 54530 - DNA, 308 bp, Homo sapiens
ctttgcagttgctctcccctcagcctggaacactgccattgcctttgccagtgggtacctccttgtcttacaggtctgagttcagatgtgctctttgtggccctccatgaccatcacctatatttagtacaagtctacccttcccccaatgcagtcgtatcttcctccttgtcttccctgtgcataccactatttgaaatcacctcgctcattatttacttatttattgtctggtttcccacaaataaaataagcaccatgagagcagggtccttggctgtctgattcagtataatattcttagaatc

SEQ ID NO: 54531 - DNA, 446 bp, Homo sapiens
tcacttatatgtggaattttgaaaacatgaactcatagaaaccaagagttgaagagtagttaccaggagtcagaagtgggagaaaagggaagctgttggtcaaactgtataaacttacagttataagatgactaaattcagagaccttttgtacagcatgatgactacagttaataataatatattgcatacctgatatttaccaagagagtagatcctaaatattctcaccacaaacgaaaggtaagtatgtgaggtaacaggtatattagttagcttgattgtggtagtcatttcaccatgtgcacatagatcaaaacatcacgttgtacatcttgaatatatttaattttatttgtcagttatgtatcaataaagctgaagaaaagagtagtacttgattgcatgtactgaacaatcaggcctgttaataatttaatattgtt

SEQ ID NO: 54532 - DNA, 490 bp, Homo sapiens
agggatggggcgtgtgagggcactggaggtgtggatagcagttggatgcccagctgggggtaggcagtctggagggtcctgaatttgggagctcagatgtgtgggccacccggacatgctggagaagggcatttggggaaaacggctctgaggggtggacacctgccctctggcctcaccagctgtggacaggtgtgtgctgattgtgtttctggtcttttaaggacatcgtgctgggctgcagatgttgctgttttttaattgaaactttattgcccgctggacatggtggctcatgccccctaatccccacctaaccctaatcctaatcacagcactttgggaggctgtggtgggaggatcacttaagcctaggaggttaagactggagtgctgtacaatcgcaccactgcattccacagcctgggcaacagagggggaccctgtctcaaaacttgttccctctgcccaacttttcctaacagtgagt

SEQ ID NO: 54533 - DNA, 340 bp, Homo sapiens
tctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaat

SEQ ID NO: 54534 - DNA, 394 bp, Homo sapiens
tcacccaagctggaatactgtggcataatcccagctcattgcagccttgacctcctgggctcagatgatctccccgtctcagcctcccaggtagctgggaccacaggcacacacctagctaaatttttggagatacaggttttgccatattgcccaggctggtctcaaactcctgaattcaagagatcttcccaactcggcttcccaaagtgctggggttacaggcatgagccaccatgcccagccaggaaatatcttttaaattgtataggaacttcaagaaacataagccagaccaaacaagacttaatgaaaagaactccctaaaagagtattatctgagatattaacataacactaaagtttattgtcttctaactccaggaactcctca

SEQ ID NO: 54535 - DNA, 338 bp, Homo sapiens
agtagctcatgctcctgggggaaccagagccaagatgcggactgtgagcgtagagaggagggatggagtctagagaggtgtagaaagtgggattgacagcaaatggagtttttgtgcagttggcatggggcgggggacagtacggtagctagagaaggcatctataatgtggggggacttttacctgaggccaaaggaatgaatcttatggtgaaatctgaggtgccgtgcaaggggattttggggaaccctgctttataccatatgagtttctgatctactgtcctatcagaaagggcttatcctcccgtctctcagtactcttagctctgggcaca

SEQ ID NO: 54536 - DNA, 450 bp, Homo sapiens
tgtttttatctctttgagggctttgttctaatatattaaagttctcctttgttcttcgtattatttttcctttcaaagtcaattgttctgtttatttctcttgctttttctcttcaatgctattgatttttcttaagtggtaatccttcgttgcccatttttatttataaatgaatggctgataaatagctagaaaggaatccttccctagctttagtagttctgttttctgacagagcttgcataggagagtctgctatgatccctgtgcagatgggtggggcatgttagagtcatttcctgtggagtgtctaggcagggaggagtgaagctgggaaatcctactattactagagttagggcaaggacacttcagtgtatggtcatggtttatttgtttgtttgtttgtttttgagatagagccttgctctgtctcccaagctggagtg

SEQ ID NO: 54537 - DNA, 385 bp, Homo sapiens
ggctgtgatgtagaaatcacacatcaccatcacttctagttgtatctcattggccagaacctactcacatgactacactgagctgtagaagatgctgagaaaggtaatctttagctgggtgggcatgtgtcaacctaaactggggggatggttgttttactagaggacaaacaaaatagatactgggtggatagggaggggcacattttctgccacaaacattaaggaattttttaaaaaaaaaactactactctcatcataagaaatgagtggcttttttctgaacttcctttcagttctccatatatattcgtaacttgtacacttgttattacagtgttggcatttgtttacacagccttctctgagcttgaatgtatttgt

SEQ ID NO: 54538 - DNA, 622 bp, Homo sapiens
catgcatggcatggagtgagtctttgcctcccctgtgcaatccttcttccccaacctgccagctttcctcttatcctgaccacagttcaccaccatcccttttccccaatctcagctgcctggtcagcacctctttcgaacattctgagccccaactttgcagtaaggtggtagaaaatggaaatccagagagctgcaaaaagatttttttttaatgtaatgaatggggagtagttttgtgaacacactcgtattcacctcttctttcctctgggaggcctgcctgccttcccctcccccccaaccttgatccctgtctgctggaaaaggcgcgattgcttctcttcctcttctgcccaagaccaagactctaggtctgatatcctttttagccacacacacacaccccccacacacgaagtcttcttaatcttcttgaatttaccagttactctggacacttcttgccataaccccatttcacagacaaaggcttaggagggaaaaagaaccaaactgtttctgtgtttgtcatgttaatgatgtccatccccacacacccagttcccatccctgatgcttcttgtgcctgtatcttgaaccttcagaatgaaaaaaaaaa

SEQ ID NO: 54539 - DNA, 543 bp, Homo sapiens
ctccgtctcaaaaaacaacaacaacaacaacaaaaaaaaaacacacaaaacagtgacttaattataattcaaaataattattagaccaagattttcactatttttaaccctaataacaaggttctagtcttcatttctctcctagttgaatgactttgggcaaatcttttcatatctagtggctgttttctcctttgtaatgaagatatgtcaaagtttatgagtacaggcttatcttgttttattgtgctttgctttattgtgctttgcagatattgcattttttttacaaattgcaggtttgtagcaacccagaatcaagtaagtctgtcagtgccgtttcccaacagcatatgcttacttcatgtctttgtgtcacattttggtaattcttgcaatattttaaactttttcattattattattatctactatggtgatctgtgatcagtgatctttgatgttactatgataattgtcataggatgtcaaaagccgcacccatgtaaaatggcaaatataatcaataaatgtgtgtgttct

SEQ ID NO: 54540 - DNA, 89 bp, Homo sapiens
ttcttcattttgtataccgtcatgacactgagtttcatataaatggtttgaactcattacttttccatgtgtttgttgtccacaaatgc

SEQ ID NO: 54541 - DNA, 922 bp, Homo sapiens
gggctaaaggattgtgggtctgtgctccatttgatagtaatctctttcccttagatgggaagagacagaaatgatcctcatagaatatttatagtccaaattctgtcaacagtgtaagcagtcataagatttatagatcttttagttagatattattgatttggttttcctttactttctagctcctgtgacttctagaagtacatctacttggagaatacccagcaggaagagacgtaagagcaattaaaaactcttaatgtaacaaatgtctttctttgctgcaaaagctacattcactttttatgttatattctttaaaataaaaaattaatttgttgggattttagatgatttgcattttacattttcaattagatgagttgggctggtataaaacataagcctcaaaatgttcaaaggcacaagtgcaatgtaagtttatttttcactcacataaataggataaagtagttcctgagtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgtcgtcctaggattgtattcagaaaagattgaacattatgtatgttccttttatttgattatgcatgaatgagataggagaaaacaatggaaggatccacactgatctgttgacttcactagctgggagaccagagacagaatagggtaggaaaagagagctttggggttatatacatttgcattcattggtcttcttatgacaagcctatattgctttcttaatttgaaaccacccaatgaaatggatgatttataataaatacatatttttcccaaagttaa

SEQ ID NO: 54542 - DNA, 1900 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcgtttgtaattgtaaagcctcaaaagacaactgttcctactatgtaattatagacagaaataaaaacttcagatcaaacactctcaaacgttagta

SEQ ID NO: 54543 - DNA, 605 bp, Homo sapiens
ccctttatttcaagatgaaattctcagggttatttatgaacagaagggaaaaatacagtgaggaaccacaaaagaaaaagagatttcagatgtagagcccatcccttaatttagctgtggggagtgggtagtcactaatgttggggggaaggagaatctttgaaggggagtgggcacaaataaaaatgtttacaaatcacaatttaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaaacggagtcttgctccgtggcccagactgaaagtgcagtggtgtcatcacagctcactgcaatctccttccaggttcaagcaattgtcctgcctcagactcccaagtagcagggactacaggaaaaaagagaaggcatagatctaaagtaaatggtctccaaagagggagaaagaaagacagacctagaaaacatttaactcttaataacaaagtccaaaagaaaaga

SEQ ID NO: 54544 - DNA, 2062 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtaagagcaattaaaaactcttaatgtaacaaatgtctttctttgctgcaaaagctacattcactttttatgttatattctttaaaataaaaaattaatttgttgggattttagatgatttgcattttacattttcaattagatgagttgggctggtataaaacataagcctcaaaatgttcaaaggcacaagtgcaatgtaagtttatttttcactcacataaataggataaagtagttcctgagtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgtcgtcctaggattgtattcagaaaagattgaacattatgtatgttccttttatttgattatgcatgaatgagataggagaaaacaatggaaggatccacactgatctgttgacttcactagctgggagaccagagacagaatagggtaggaaaagagagctttggggttatatacatttgcattcattggtcttcttatgacaagcctatattgctttcttaatttgaaaccacccaatgaaatggatgatttataataaatacatatttttcccaaagttaa

SEQ ID NO: 54545 - DNA, 1798 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggtgtgccaagaagccaagaagcaaggactgaaagtagtcaagcatctgacatgatggataccatggatgttgaaaacaattctactttggaaaaacacagtgggaaaagaaacggagtcttgctccgtggcccagactgaaagtgcagtggtgtcatcacagctcactgcaatctccttccaggttcaagcaattgtcctgcctcagactcccaagtagcagggactacaggaaaaaagagaaggcatagatctaaagtaaatggtctccaaagagggagaaagaaagacagacctagaaaacatttaactcttaataacaaagtccaaaagaaaaga

SEQ ID NO: 54546 - DNA, 2069 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtaagagcaattaaaaactcttaatgtaacaaatgtctttctttgctgcaaaagctacattcactttttatgttatattctttaaaataaaaaattaatttgttgggattttagatgatttgcattttacattttcaattagatgagttgggctggtataaaacataagcctcaaaatgttcaaaggcacaagtgcaatgtaagtttatttttcactcacataaataggataaagtagttcctgagtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgtcgtcctaggattgtattcagaaaagattgaacattatgtatgttccttttatttgattatgcatgaatgagataggagaaaacaatggaaggatccacactgatctgttgacttcactagctgggagaccagagacagaatagggtaggaaaagagagctttggggttatatacatttgcattcattggtcttcttatgacaagcctatattgctttcttaatttgaaaccacccaatgaaatggatgatgttgtgaggggtggggggggtgggggggttaaaaaaaaa

SEQ ID NO: 54547 - DNA, 835 bp, Homo sapiens
  misc_feature (7)..(7): n is a, c, g, or t
ttttcgnacccacgcgtccgaccaggcctctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggtgtgccaagaagccaagaagcaaggactgaaagtagtcaagcatctgacatgatggataccatggatgttgaaaacaattctactttggaaaaacacagtgggaaaagaaacggagtcttgctccgtggcccagactgaaagtgcagtggtgtcatcacagctcactgcaatctccttccaggttcaagcaattgtcctgcctcagactcccaagtagcagggactacaggaaaaaagagaaggcatagatctaaagtaaatggtctccaaagagggagaaagaaagacagacctagaaaacatttaactcttaataacaaagtccaaaagaaaaga

SEQ ID NO: 54548 - DNA, 1816 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacaggcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcgtttgtaattgtaaagcctcaaaagacaactgttcctactatgtaattatagacagaaataaaaacttcagatcaaacactctcaaacgttagta

SEQ ID NO: 54549 - DNA, 1858 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaaacggagtcttgctccgtggcccagactgaaagtgcagtggtgtcatcacagctcactgcaatctccttccaggttcaagcaattgtcctgcctcagactcccaagtagcagggactacaggaaaaaagagaaggcatagatctaaagtaaatggtctccaaagagggagaaagaaagacagacctagaaaacatttaactcttaataacaaagtccaaaagaaaaga

SEQ ID NO: 54550 - DNA, 922 bp, Homo sapiens
  misc_feature (64)..(64): n is a, c, g, or t
ttctacttcaatagttgagtgcccagaccacgcaagatctcatcatatccaggcatgtgacatnatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctgtgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaaacggagtcttgctccgtggcccagactgaaagtgcagtggtgtcatcacagctcactgcaatctccttccaggttcaagcaattgtcctgcctcagactcccaagtagcagggactacaggaaaaaagagaaggcatagatctaaagtaaatggtctccaaagagggagaaagaaagacagacctagaaaacatttaactcttaataacaaagtccaaaagaaaaga

SEQ ID NO: 54551 - DNA, 2331 bp, Homo sapiens
gtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 54552 - DNA, 2140 bp, Homo sapiens
agatttcaagtcataaagtcagctaggaacaggccgaggcagggagaactctccactcggaggaggagctggggtcctcttccatcccgtcttcatcctgcctggctgcgtgacctcgggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 54553 - DNA, 522 bp, Homo sapiens
aagctttaggctcgtgccgaattcggcacgagaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 54554 - DNA, 231 bp, Homo sapiens
agattcggcacgaggggtaatctccaatgccactcactctatgaagtcttccacaatccttcctgagaaaaataaaaggtcttatcccttctgttcccccagcatttcacctgcaacctctatcctggaacctgtcctccctttctccccaactatgcatctgttgtctgctcctctgcaaaggccagccagcttgggagcagcagagaaataaacagcatttctgatgcc

SEQ ID NO: 54555 - DNA, 231 bp, Homo sapiens
  misc_feature (142)..(142): n is a, c, g, or t
agtgagacacgtgggactatctttgtatcataaaggaaaggtaccgaaaacagttgacatcacaactccaggcgggacaaacactgacgtctttgggtctaactgctcaattaaccagcaggaactgacctgctgtttgcantttaccccaactatgcatctgttgtctgctcctctgcaaaggccagccagcttgggagcagcagagaaataaacagcatttctgatgcc

SEQ ID NO: 54556 - DNA, 2075 bp, Homo sapiens
  misc_feature (2)..(2): n is a, c, g, or t
  misc_feature (4)..(4): n is a, c, g, or t
  misc_feature (13)..(13): n is a, c, g, or t
gncntttcggccnttatggccgggggcctccgctggactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 54557 - DNA, 1794 bp, Homo sapiens
gtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcctccctcctctgtgctgtcctcctctgtgctgtcccagcacagaggaggtctggggcattggatcaggtggcatgtgggtgtctacacatcgagaagcacacagggatgagccactaggtatcccatgctggaggcttgtggaaggctgtgctcatctcccatgtttcccctcctctgtgcctcctctgtggtacctcaga

SEQ ID NO: 54558 - DNA, 1123 bp, Homo sapiens
gtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagcggaccggtccgctcggacgagactgcacggattgttttaagaaaatggcagacaaaccagacatgg

SEQ ID NO: 54559 - DNA, 766 bp, Homo sapiens
gtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgcagagcagaaggtcgacgcagagcaga

SEQ ID NO: 54560 - DNA, 807 bp, Homo sapiens
atagtgtgccaggcactgttcagtatactggggatagagcagggggaaaaaaatgacaaaaacccctacccttaagaggttcacagtatagcatggggaattagaaataagcatctgtctcttctctggtctttaagcacctcacaggcactggccatgtctgctcatctgtttattcccatcatctaacagagtgctcaacacatttgcttgatgaatacgttttgagcactgggagatgatcacagaagagctaagaagtgatagcagttgtatttagtggagaacagtattcacaccttgttgtctagattgccttgaaatcaggctctgtatgatatcttttttttttctcttagaaaaaactgttaacctatttagagtaattttattaaggagctttttatttttttatttttttttttgagacagggtcccaccctgttccccaggctggagtgcagtggttcaacaaccacagctcacttcagccttgacctcccgggctcccacctcagtctcctgagtagctgggaacacaggtacgtgccaccctgcccagctaattttttattttttgtagagatggggttccactgtgttgcacaggctggtctcaaacttctgggctcagtcaatcctcccgccttggcctcccaaagtgttaggattacaggcgtgagccattgtacctttaaaagaaaaaaagaaagattttttttattttaaattaaaaattatgacattgcatatcactgtgagtgtatttaatgttactgaattgtacactttaaaatgattaagatg

SEQ ID NO: 54561 - DNA, 448 bp, Homo sapiens
gccttgtttatctcttcgagagagtctcgcctcacccagatagcctcaactcctaggtcagcctcccagagcagttttggttggttggttggttttaagagatgttactgttgccagacgtggtcttgaactcctggctcaagcaaactcccaacttgagctcccaaaatgctgggaacacaggtacgtgccaccctgcccagctaattttttattttttgtagagatggggttccactgtgttgcacaggctggtctcaaacttctgggctcagtcaatcctcccgccttggcctcccaaagtgttaggattacaggcgtgagccattgtacctttaaaagaaaaaaagaaagattttttttattttaaattaaaaattatgacattgcatatcactgtgagtgtatttaatgttactgaattgtacactttaaaatgattaagatg

SEQ ID NO: 54562 - DNA, 246 bp, Homo sapiens
tttttttggcagtatgagttaagtagtttatttaacatttggagtcagatatacctgggtctgaattttagtgtacttaacaataagattgagttaataattgtgtttatctcagaaagatctgtgataaggaccaagtaagataatgtacataaagctcttagcacaaaacataacacatcacactcaatagattttccctgtaaaaaaattcaacagttgattaaagactagaaccatttcact

SEQ ID NO: 54563 - DNA, 394 bp, Homo sapiens
gagtgcctggtctacgggtgtttacaatcatcaccgggcacccacaagagaccctgaacttagaatatttccgcggtaggagttccgcctcgtccttccaggggatactgacgactcgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccct

SEQ ID NO: 54564 - DNA, 100 bp, Homo sapiens
  misc_feature (79)..(79): n is a, c, g, or t
agcttctgctaatcaagaatatactatgaaaatcatcagagacctagcaactgttgagcttggttttggctgtcaggcnctgttctgctgatggattgag

SEQ ID NO: 54565 - DNA, 355 bp, Homo sapiens
actattgcataccatattttgaatattcttttaagtaacttttcaaaaggccacaacatgctgacttctaaaatattagtacgtaatgtcattttaattggaaaatatctccaaaccagcaagttattttatttcatttactatgatttatctgcaattaaaatagaatatgttttacaaaatcataatgatccaaatatgtcccgctacaggagttcgagaccaacttgggcaacataatgagaccctctctatacaaaaaattgaaacattagctgggcttggtggcatgtgcctgtggttccagctactcaagaggctgaggtgggagggttgcttgagcccaggaactcga

SEQ ID NO: 54566 - DNA, 1026 bp, Homo sapiens
ttcgggatacatcttggagctgctcagtctttgggtctgagcagcctttatgagcggtaacacttaccgcgaaggtctgcagcttcactcctgaagccagcgagaacacgaacccaccagatgggacgaacaactccggacgtgaggcctttaagagctgtaacactcactgggaaggtctgcagcttcactcctgaagtcagcgagaccacgaacccaccagaaggaagaaactccagatgcatctgaacatctgaaggcacaaactccagacacggcatctttaagaactctaacactcaccttgagggtccgcggcttcattcttgaagtcagggagaccaagaacccaccaattgcggacacaagaggaagtaatttgaaggcaagatgggagggacagatgaactggataaaggggtacaaaagtggggcagggtggtaaagtgggcagagggaacagcacgcgtaaaaggcctagatgagagaaactcacagagaggaacagtatggtgcaagtgtagagagtggtgccagtgaggctgggcaggtaagcaaggacccacctcaggcaggtctttcggccatagcgatgatttgggattttgtaccaagtgcaatgggaaagctattaaaggttgtttaaggatttgggattggcatttctttttaaaggccactctggcagcttgatgcagaaaagttctaaattctcaacttgcaacctaaagggatctcctttctttgcttttaattttgacctcaattgctctgccaaaactcattgcatacaccataattcttgctttgtatttacttgcattgttactttatgtgctgccttcctttactagttattcatagacttgactcactgatgcaccctaccccaactgtaaccttttcctgtgggcagaaaagatttctcagtcattgttgtgtgcctacagcatggagcagatacacttggctaatctgttaaaccagattgcgctaaaagtcccatcatagtttgctgctttcccc

SEQ ID NO: 54567 - DNA, 589 bp, Homo sapiens
cacacataaactagaaaacctagaagagatggataaaatcttggaaaaatacaatcctcctggcttaaatctggaagaattagataccttgagcagaccaataacaagcagattaaaatggtaactaaaaagactgaaatggtaactaaaaaattgtcaacaaaaaaaagtccaggaccagatggattcacagcagaattctatcagacattcaaagaattggtaccaatccttttgacactattccacaagacagagaaagaaggaaccctccctaattcatcaccctaataccagaaccaggaaagaacataaccaaaaaaagaaaactacagactgatatcgccgatgcacatagatgctaaaattcttaacaaaatactagctaaccgaatccaacaacatatcgaaaagataatccaccatgatcaagtgggtttcataccaggcatgcagggatgctttaacatatgcaagtcaataaatgtgatatgttacataaacagaattaaaaacaaaaaaatcacatgatcatctcaatagatgcaaaaaatgcattagacaaaatccagcatcgctttttgattaa

SEQ ID NO: 54568 - DNA, 2000 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54569 - DNA, 773 bp, Homo sapiens
  misc_feature (761)..(761): n is a, c, g, or t
caggcaaccagtcaagtttttactaactgctggatagagccagcagcatttcggttgggctttaaaagaaacattggaaaccgatgagtggaaaaatgaagacagggttgtccaggtgtggtagacagtgtgaacacaggcatggagatgggaacctgttgtatttaaagagaccccactcatcctcaggggttgccaccctttggctaaggtctggctgctggggcagtggctgacttctctgatgtagtaggaaactgacacataccttggaaaggaggtaatttcaaaagtgttatctgaagacccaatcttgctgccaccaccctggttttgagtttccagagtaaattccttgtgctcagctgaaaatattgatggtaatctctttctcggctgttctctggaaaccacccatgatgactcttcttcattgcagatgaacggatcctttccattctgagacatcagaatttactgaaggagctccaagacctcgctctccaaggtattttccagccactgcacttgactctgggtaaattccagtaactgagagtcagaaaatctggtggaagattcagcaagttcctctctgggactgtcatttccttttaattataaagcggaaaagcaggatccgccgtgccacctggctcaatctgttattgatattgttaaagaaatcaaggcccagagaggttgagtgacttgtccaaggtcacacagtgaatagagacatgccaggtgaaatggaactngatcctctagat

SEQ ID NO: 54570 - DNA, 1760 bp, Homo sapiens
gtgaccccagcactctcttcttcttcccagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54571 - DNA, 2028 bp, Homo sapiens
caggcaaccagtcaagtttttactaactgctggatagagccagcagcatttcggttgggctttaaaagaaacattggaaaccgatgagtggaaaaatgaagacagggttgtccaggtgtggtagacagtgtgaacacaggcatggagatgggaacctgttgtatttaaagagaccccactcatcctcaggggttgccaccctttggctaaggtctggctgctggggcagtggctgacttctctgatgtagtaggaaactgacacataccttggaaaggaggtaatttcaaaagtgttatctgaagacccaatcttgctgccaccaccctggttttgagtttccagagtaaattccttgtgctcagctgaaaatattgatggtaatctctttctcggctgttctctggaaaccacccatgatgactcttcttcattgcagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54572 - DNA, 2068 bp, Homo sapiens
  misc_feature (2068)..(2068): n is a, c, g, or t
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcaaaaaaaaacaacggaccacaaaaaacccaggggctctaataccggggtgccgcacaacacaggcatn

SEQ ID NO: 54573 - DNA, 3018 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcaaacaaaacaacacccacacacaccacacacacaacacaccaggggggcccgccacagaatataacccccccgggagagcgcccccaacgtctaccgcgcggacccccacaccaatactcggccacacacgcggcgccccctacaaacagaccacacacacacaccagccacaggccctgcgccccgccacttcacaacacgccccgcgaacggcgcacacacacggcaaccatgaggcaccccccagggagaagagacccccctaactcccggagggggggcgcaccatattcgtgcgcccaacacatccccacaccaacacatttcacagcagcccaaaagggaacaaattaacactcccacacgggcataaagcggcggctcacctcaaccccagcatatagactgcgacagcttggaagaagcctggagaacaaccccgggagccccagcacaccgtcgcaacaccatctattccacccccgcggcccacacatcatcaccaaacccccaccccgcccccaccaacaacacacacagcaccgacaccacccaccaaacaccaccccccacaccccacaacagcagccgcacgccggctcatccacacagggcgcagagggcagcaaccgcgcgacccggggcagtcggtgggcgggcaccgacagcgaggggaggtcgcagccacagcagcggcacaggccaggaagcccgcaggagcaggtcgggagtggacggaggagcggaccagggcgcgtgggcagggcacagggggacgaggacgggcgaagacgaggcacacggccaaggtacgaaacgcaggggagcacgcaggaggggagcgcacagggcgcagcgacacacgacacagcggacacgcgctgcacaagagacgcgcggggggcgcacagtcgcaaccaggagccaggggcgcgtgcgacgcggtggcacagacgaggggcgtgacagcacagccacgccccgtgaagaacggtggcccgcaccactgagacacga

SEQ ID NO: 54574 - DNA, 1704 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54575 - DNA, 1547 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaaggtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54576 - DNA, 1727 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54577 - DNA, 1675 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccccagctgcaggcactacggcggggctgagacaccggctggcagggctggccg

SEQ ID NO: 54578 - DNA, 1873 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcaaaaaaaaaaaaaaaaaaaaacaaaaaaacaaaaaacaaaacaaaacaaaaacaccagcacagagggaatcacattgccgagcacaagcaagtgaagacgaggacacacgaggcaaggacaacacccaagtgtgaaaagggagaaacggcgacctcagaagagaaacatagaaaagggagaccatgtaacacag

SEQ ID NO: 54579 - DNA, 768 bp, Homo sapiens
tttttttcagaggaaagagcccagaacagatttatttttctttagataaagttcatacagaatatgttacagtcaggagttctcagctttcaccaaaaggtcagaagttattgcagttgtgcccagtggataggaaaaaggaagggaaacttctagaaagctgcctgtgttcagagaaggaatcgtcaatgtttaaagtttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54580 - DNA, 1310 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagcttagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54581 - DNA, 317 bp, Homo sapiens
agtaagctcattatcactgtctccatgatggatgagggtacagagagacaaagccacctgtccgaggccacacagctaacccagcgcctttctggcttactgtgccttccatgccactggccaggctggcccgagtgaaccccaatgtctctcctaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccag

SEQ ID NO: 54582 - DNA, 483 bp, Homo sapiens
ctcttccggggtgggaagagcggagagctggagcagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54583 - DNA, 2481 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcaaaaaaaaaaaaaaaaaaaaacaacacgacacaaaaaaacccccgcggggctctcttgggggggggcgcggacacacggcggtgttccaaaagggggccctgggccaaggtgtttcccgcgcccccttcttttttcccccggggggaaaccccggggcaccccataagggggggcaataaaaattggaagacgcgccgggttcccctttttgtatcttcgcccgtccataccgggtgtcactgcacctgacagcaaaacgaggtgcaacacaatttagaaaccaatgcgtcaggagagaaattgaccgacggcacataactgattgtcccgaagcgagtagcatcgaccaacactccgacacagcgtagtcatcgtgcacagcagactaatcgcagtaacagaacagtaagtcagcacagactatcgcgcagatctcgccacgtctgactcgtcaatcgctcaacgaccaagtgcaaggcc

SEQ ID NO: 54584 - DNA, 1869 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaagggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54585 - DNA, 1218 bp, Homo sapiens
tttttttcagaggaaagagcccagaacagatttatttttctttagataaagttcatacagaatatgttacagtcaggagttctcagctttcaccaaaaggtcagaagttattgcagttgtgcccaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54586 - DNA, 1778 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54587 - DNA, 1972 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctcctgctttcggtaggaggcagctccagctggccaagcccagcaacctatgcccctagcgcttgttctatcctgactctactgcctggacatctttgcagggaggccacaatttacatgacgattctttctgacacgggagttctaaaattccttctcatctatcctggcgactgataatttgcttgggagtggacctgccgacatttgtgagtttgaaaatttggaaaaaacgggttcggggagaagggaggtttcctttag

SEQ ID NO: 54588 - DNA, 1840 bp, Homo sapiens
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54589 - DNA, 628 bp, Homo sapiens
gggaggaggggggcagcgcaaaccgcagaccagaggaccaggagctggagagcctgtcggtgaggcgggcctgcccctccaggtccgaggctaccccgaggagaagaaagaggaggagggcagcgcaaaccgcagaccagaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttc

SEQ ID NO: 54590 - DNA, 1601 bp, Homo sapiens
  misc_feature (1240)..(1240): n is a, c, g, or t
agggcgctgctgctgccaccgctgctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttcctggtggttggtgaatgatgctggatgatgcttggatgcagtgagtgatgtgatgctgtgctctnccaatggatgttggtgtgatgtgactccataactgcttggatgcaagattggaccatgctgtgccaaatggagcttgactggcttgaagaaggctgtgcttgggatgtgtgtgcacgtgacgtgacgtgacgtgatgtgacatacctgtggaacattgttccattgaaagctctccttcctgggtgccctggggcctactgtgcttcatgtgtgtgcccttgtggcctgctggcttgctgacgaaggcttggatggccatccctcccctggggatggatcagcctttgaggctgtggcctgccccctccaggtccgagggctaccccctgaggagaagaccgatggagtggtggcagtgcc

SEQ ID NO: 54591 - DNA, 418 bp, Homo sapiens
aggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctc

SEQ ID NO: 54592 - DNA, 2383 bp, Homo sapiens
cttcccttggggctttaaaaaccacagcccttgggcaggagggaccttcgatcctcggggagcccaggagaccagaacatgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccacccccccccacacaccatctttccatcccaggcttttgaaaaacaaacagaaacccgtgtatctgggatatttccatatggcaataggtgtgaacagggaactcagaatacagacaagtagaaagattctcgcttaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaaccttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaatgttgtgttatttctag

SEQ ID NO: 54593 - DNA, 2167 bp, Homo sapiens
aagtgctggctctcgtgcccccgcgggactagtctgactgggattcagtcgagcgggcgccgcatacggctgcggtctggtaccgtgcgaggtagtcctctagactcgacccgctcgtgtctgaggctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccacccccccccacacaccatctttccatcccaggcttttgaaaaacaaacagaaacccgtgtatctgggatatttccatatggcaataggtgtgaacagggaactcagaatacagacaagtagaaagattctcgcttaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaaccttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaatgttgtgttatttctag

SEQ ID NO: 54594 - DNA, 416 bp, Homo sapiens
tagctgggactacaggcaagtgcaaccacgcctggctaatttttgtattttcagtagagacggggttttgccatgttgcccaggctattctcaaactcctgggctcaagcagtccgcccgcctcggcctcccaaagtgctgggatgacaggcgtgagctacggcatctgcctcaatattttaataagtggtgtgacaccctagttgactctcagccctcagcatccccatttcctagtgagaaaaagccacacaggggaaaagccacatgcctgagccaggatgccccctacccgggcacatgtctgcagactcatcctctctgctctctccgattccccttagaactccttcaattataccacccctgattatgggcactatgatgacaaggataccctggacctcaacacccct

SEQ ID NO: 54595 - DNA, 1330 bp, Homo sapiens
cttcccttggggctttaaaaaccacagcccttgggcaggagggaccttcgatcctcggggagcccaggagaccagaacatgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtcgcgatccatctgccacgccggatatacactggacatcacgctagaccaagaggta

SEQ ID NO: 54596 - DNA, 432 bp, Homo sapiens
actgctggcccccttggcctccgcacctatgaccacagggggcaaagaggaaaggtgcaacccagcagggaggccaaggacagtgtagtgctctttccagctgttctggagcctaaaataaaagccatctcaaaaaggaagacaggagctgggtgtagtggttcacgcctgtaatcccagcactttgggaggctgaggagggtggatcaccagaggtcgggagttcaagaccagcctgaccaacatggagaaaccccgtctctactaaaaacacaaaattagccaggcgtggtggtgcatgcctgtaatcccagctactcatggagtagctgaggcaggagaatcgcttgaatcggggaggcggaggttgcagtgagatgagattgcaccattgcactccagtctgggcaacaagagtgaaactccatcttt

SEQ ID NO: 54597 - DNA, 539 bp, Homo sapiens
gcaggaactactgcctcatgatagcatcttgtatactttatactcgcttcttatttctctgccccttatcccctcccttcccactaagatggggagtttccatctcaaaaatcccatacaagaaatgagagaggagagagagggagaaattatctgatagacgagacagtatttttcacggttaattgaggatgattttcataactggcaaatgtcattttgatctttgctattagaacatctgcaccatctcacaacaggaagcacagctatattccttgggatttacctattcttagaactaagagcacacattccaccagctgtctcgtgttgaaaatgttagctttccaaatccacgcaattggattgagcgtttataaatagattcaataaaaggaggttccattaggtctatacactaaaactggaattttttaaagatcctccaaggccccttttatttggtctgttcttgaatcatgccctgagagcaaaccatgcagttttattgctgaagataatatacattgtttttt

SEQ ID NO: 54598 - DNA, 298 bp, Homo sapiens
ccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtg

SEQ ID NO: 54599 - DNA, 1172 bp, Homo sapiens
gacaattcataaaggaaagattacactaagaagtaaaactattttatgcaaaagcctctatgagtaaagctaaaagacaaactctgaactggaaaaatattttttcaacacataaagcagaaaaaaacgtttcagactatatagtcagagaatccttacaaatcagtataaaaaagacggacaacttactacagaaatgggttgcaaaggataccctcaggcaatacacagaggagcggatttaaagaaccaataaacataagagatgctgaccttactaacaattaggagaaatgctggctgaaacaaaaactaccctttctcgcccttcataatggcaaaaataaagaaacatgactgtccaaatattgggccggatgaacgaaactgggcatgtagtgtggtacaccactttggaaagcaagttggcaatacctgctaaaatttgaaatgtggtccataaccaagcagttttaccacaacaaatatttcccaaagaagcacttgcaacagaagccctgtacaaggatgttcactgaagcattttttttgtcatgatgagacctaatgtctcttaatggagagatgaaaataaattagagtatgttcatattttgtttccttcattgctgtgctcccagccaccggaacatttcttggaacattgctgatgcacataaatatttgttgaatgaatgaatatggtggaacccacataacagttgaaaatgaataaattagatccatatgtatcaacatggatagatttcagaaacagcgttgggcgaacaaagtgactttagagtatggatgttatggtacaattttaatatgcataaaatgatactatatgctgtttatagatgcctatgtgtagtaaaaatattaaaatgtactgaaaaacacaaaaattataatgccagttgcctctgggaagggaaaggaaggcaggatttctctaggaaagagaaagaggaaaggagaagaaggagggtaggcattgggaaacaggagacttaagtttacctctgtggccttatttcttttaataagaaaattcatctgaagtacaaatgacaaaatgtaaactttttttaaaattctgagttgtaaatgcatgagtgcgctctctatgccctctttaactctaccactttccctcaggaagatat

SEQ ID NO: 54600 - DNA, 401 bp, Homo sapiens
  misc_feature (1)..(1): n is a, c, g, or t
  misc_feature (294)..(294): n is a, c, g, or t
  misc_feature (400)..(401): n is a, c, g, or t
natggacaggtagatgaatgaatggatagatgggtggataaataaatagaaaagactacagagctttgtacatgtggctgagagacccacgtaaactcagggagcacctactgtagtggtgaagcatgtagctgttggagccagtctgagggggccaaatcccagctctactgcttacatggtttaaaacaaaggcacaaaatatttgatgctccctcttcaagagatggagcctacgttccttccccttacatgttggctggatttagtaactcatttctgttaaataaagtngaagtgatggtgtgtaactttagagactaagtctaagggtgctgtgggttttctctttctctctggaattgtttgctttggggaaaattagctatcatgttgtgann

SEQ ID NO: 54601 - DNA, 269 bp, Homo sapiens
  misc_feature (162)..(162): n is a, c, g, or t
  misc_feature (268)..(269): n is a, c, g, or t
tagtagagctgggatttggccccctcagactggttccaacagctacatggtttaaaacaaaggcacaaaatatttgatgctccctcttcaagagatggagcctacgttccttccccttacatgttggctggatttagtaactcatttctgttaaataaagtngaagtgatggtgtgtaactttagagactaagtctaagggtgctgtgggttttctctttctctctggaattgtttgctttggggaaaattagctatcatgttgtgann

SEQ ID NO: 54602 - DNA, 1200 bp, Homo sapiens
ttgagacaagtgacagagtctctgttgcttaggctggagtgaagtggcatgatcatagctcactgcagccataaactcctgggcacaagtgatactcccacctcaacttaccaagtaggtagaactaaaggtgagcatgatcacacttggtcaatttttattttttgtagagatagggtttctctatgttgcccaggctggcattgaactcctggccttaagtgatgctcccactttggcttcccaaagttataggattattggcatgagctactgtgcacaggcaaatttactttctttataaattacctagtttgtgatattccattatagtaacacaaaatgaactaaggcaaaggactatagtcagaattacctaaaaccatgttgggaaagcattaagcaggacatatggtctaatttgccataggttctcaattcatgatttttttctccttttgattccaagcccaattgttttttttcctacagcatagggtgaacccccaacatcggaggcaggtctcagttaatttagaaagtttattttgccaaggttgaggatgggcaaccatgacacagcctcaggaggttctgagaacttctgcccaaggtggtcagggcacagcttggttttatacattttagggagacatgagacatcaatcaatatgtgtaagatgtacattgggccaatccagaaaggtgggacagctccaggtgaaggcaggacagctggaagcctggaggggacttccaggtcataggtaggtaagagaaaaatggttgcattcttttgagtttctgatgagcctctccaaatgaggcaatcagatatgcatttatctcagtgagcagagtggtgactttgaatagaatggaaggcaagtttgccctaagcagttcccagcttaactcttccctttagcttagtgattttggggccccaagatttattttcctttcacaatactataaaacatgttaatgcacttctattagttaggttccttttgattgcaagcaacaactacccaattcaatatagcttatgaaaaagaaaatatattttaaggatacaagggtatcttggagcatctctgagaattcaagatttcaggaatgatctgaggacagggaagggagtttctctttgggccacttcttttcttttctttttttttttttttttccccaaga

SEQ ID NO: 54603 - DNA, 572 bp, Homo sapiens
agggcatattccaaccttccagcctgcgacctgcagagaaaaaaaaattacttattttcttgccccgtacataccttgaagtgagcaaaaaaattaaattttaaccatgagggaaatcgtgcacatccaggctggtcagcgtggcaaccagatcggtgccaagttctgggaggtgatcagtgatgaacatggcatcgaccccactggcacctaccacggggacagcgacctgcagctggaccgcatctccgtgtactacagtgaagccactgatggcaaatatgttcctcgtgccatactggtggatctagaacctgggaccatggactctgttcgctcaggtccttttggccagatctttagaccagacaactttgtatttggtcagtctggggcagagcccccatcacctcaggcttctcagttcccttagccgtcttactcaactgcccgtttcctctccctcagaatttgtgtttgctgcctctatcttgttttttgttttttcttctggggagggtctagaacagtgcctggcacatagtaggcactcaataaatacttgtttgttg

SEQ ID NO: 54604 - DNA, 534 bp, Homo sapiens
agggcatattccaaccttccagcctgcgacctgcagagaaaaaaaaattacttattttcttgccccgtacataccttgaagtgagcaaaaaaattaaattttaaccatgagggaaatcgtgcacatccaggctggtcagcgtggcaaccagatcggtgccaagttctgggaggtgatcagtgatgaacatggcatcgaccccactggcacctaccacggggacagcgacctgcagctggaccgcatctccgtgtactacagtgaagccactgatggcaaatatgttcctcgtgccatactggtggatctagaacctgggaccatggactctgttcgctcaggtccttttggccagatctttagaccagacaactttgtatttggtcagtctggggcaggtaacaactgggccaaaggccactacacagagggcgccgagctggtcagtgtggcaaccagatcggtgccaagttctgggaggtgatcagtgattaacatggtccccttcccacgtctccatttctttatgcctgg

SEQ ID NO: 54605 - DNA, 1006 bp, Homo sapiens
taaataaggacaataaatgaagtataactgaacaaaataataatccgtgtgttaatttaactagtaaaatagagaaatacagctggcacgggggctcacgcctgtaatcccagtactttgggaggccgaggtgggtggatcacctttgcttgggagttcgagaccagcctgaccaacgtggagaaacccgtctttactaaaaaaatacaaaattagccaggcgtggtggcagatgcctgcaatcccagctactgggagtctgaggcaggagactcgtttcaatccgggaggcggaggttgtgctgagccgagatcatgccattgcactccagccggggcaacgagcaagactccatctcaaaaataaaaaaaaaataaaaaaaaatagagaaatacacaaatgagaggttatagtcatgttagtagcaaaaattgattcaggtaaagtttatctgggtgctaaatcttggatgaggggagggagtttcccaggaaacaagttacgaacatgatctcaaattcactgccaatgaattatttatgtgtttatttttctttttttcctttttttgtggagacgggaggtgggtctcgctgtgttgcccaggctggtcttgaactcctggcctcaagtgatcccaccactgtagcctcaaagtgctgggattacaggtgtgaaccaccatgcccagccagattatttattaattataaatagagaaatggtaactataaaatggggatgtaggaggcaaggatagatgtcatgtgtgcttccagacatgacactttgagaacacaacatcatttatgaaatatctaagccgaaaatttttaacaacctgaatccagtcatgaggacacccaatctaaatggcattcaacaagatacctggcctgtgttcttcagaagtgtcatgctgagagaaacaaaggttgggaaaattgtgaactgctcattgtgaacaattgagaaacttggaatatggattttcaattgagtaaa

SEQ ID NO: 54606 - DNA, 950 bp, Homo sapiens
  misc_feature (4)..(4): n is a, c, g, or t
  misc_feature (10)..(10): n is a, c, g, or t
  misc_feature (65)..(65): n is a, c, g, or t
  misc_feature (82)..(82): n is a, c, g, or t
  misc_feature (91)..(91): n is a, c, g, or t
  misc_feature (103)..(103): n is a, c, g, or t
  misc_feature (111)..(111): n is a, c, g, or t
  misc_feature (119)..(119): n is a, c, g, or t
  misc_feature (130)..(130): n is a, c, g, or t
  misc_feature (133)..(133): n is a, c, g, or t
ctcntcccgnacaaatctcccggacacattccggcgcgaaactacttcgtcgcacatactctcgncacaggccgcgcctccncagggcgangaaaattggagnaacccttngtaaaaanaccgcgcaggnggncgatctagaatagaggatcccccgggctgcaggctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccaagtggaacactaatctggggaaactttaaaacatctagaagtaaaaaattggcaggttgggataaaaaaggaccctgcttcctggagaaaaggaaaacactttaaaataaagggtcggggaaagggaaccacggccccttttttttttttt

SEQ ID NO: 54607 - DNA, 2325 bp, Homo sapiens
  misc_feature (2282)..(2282): n is a, c, g, or t
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54608 - DNA, 1364 bp, Homo sapiens
  misc_feature (1321)..(1321): n is a, c, g, or t
tacgatcgagctcgtacccgacgttactgcacctgcgacacaaaaaccccaaaacgggtatctatgaagaaaaacatgctaagaggccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54609 - DNA, 2139 bp, Homo sapiens
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacactagcagtaatattgcggtgggatataaagagccgtgctgtgacagaacatttcctatggggggatgtactgagctttttttcctggttc

SEQ ID NO: 54610 - DNA, 1225 bp, Homo sapiens
  misc_feature (1182)..(1182): n is a, c, g, or t
tccaagtgacatggcacagggcatggattcatagagggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54611 - DNA, 1255 bp, Homo sapiens
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaagcctctgagagtgggtgtctcttggagaggcctgccccacctttcgtgttcacttcagcttctcacctcg

SEQ ID NO: 54612 - DNA, 3086 bp, Homo sapiens
  misc_feature (2695)..(2695): n is a, c, g, or t
  misc_feature (2729)..(2729): n is a, c, g, or t
attatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggcctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaactggttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcacccnccgttgacagtatatgtcatgcctcactttcttntagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacttaatgaatgaccagcagcagctttcagctcttaaaaagacacttatattttgattttacatgctggttacctgttccattgttgtcaaatgcccagtgtccatcagatgtgttcctccattttcttatccacaaagtactcctcacttttcaatttgtcatgttactaaatggtgttacattaaagccctgtgttaagtgtc

SEQ ID NO: 54613 - DNA, 3432 bp, Homo sapiens
  misc_feature (3041)..(3041): n is a, c, g, or t
  misc_feature (3075)..(3075): n is a, c, g, or t
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaaaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggcctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaactggttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcacccnccgttgacagtatatgtcatgcctcactttcttntagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacttaatgaatgaccagcagcagctttcagctcttaaaaagacacttatattttgattttacatgctggttacctgttccattgttgtcaaatgcccagtgtccatcagatgtgttcctccattttcttatccacaaagtactcctcacttttcaatttgtcatgttactaaatggtgttacattaaagccctgtgttaagtgtc

SEQ ID NO: 54614 - DNA, 1466 bp, Homo sapiens
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcatcccagtccgagtttttatatcgtaatcagtatcgagctcgcgcgc

SEQ ID NO: 54615 - DNA, 681 bp, Homo sapiens
  misc_feature (638)..(638): n is a, c, g, or t
gtcgactctaagatcccgctggtatgccgatcggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54616 - DNA, 4170 bp, Homo sapiens
  misc_feature (3779)..(3779): n is a, c, g, or t
  misc_feature (3813)..(3813): n is a, c, g, or t
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggcctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaactggttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcacccnccgttgacagtatatgtcatgcctcactttcttntagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacttaatgaatgaccagcagcagctttcagctcttaaaaagacacttatattttgattttacatgctggttacctgttccattgttgtcaaatgcccagtgtccatcagatgtgttcctccattttcttatccacaaagtactcctcacttttcaatttgtcatgttactaaatggtgttacattaaagccctgtgttaagtgtc

SEQ ID NO: 54617 - DNA, 236 bp, Homo sapiens
gtcgtggtgattagaggatccggcgcctagcaacttcctaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaaaaggacaagggagatgaggaggaggaagttgcctagggcgg

SEQ ID NO: 54618 - DNA, 1300 bp, Homo sapiens
  misc_feature (1257)..(1257): n is a, c, g, or t
cggcacgaggcctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54619 - DNA, 2114 bp, Homo sapiens
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacacatagcggggtatacctggccattggaaatggaccctgttttttgagggttttcctcttgttttc

SEQ ID NO: 54620 - DNA, 1160 bp, Homo sapiens
  misc_feature (1117)..(1117): n is a, c, g, or t
tacgatcgagctcgtacccgacgttactgcacctgcgacacaaaaaccccaaaacgggtatctatgaagaaaaacatgctaagaggccagatgaagaggccacaaaacccgaaggctggttagatgatgagcctgagtacgtacctgatccagacgcagagaaacctgaggattatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaataattaccccatttaaaatgtcggggatgnagttgggtataaagattgtccgttgggtgggaaaatcactttg

SEQ ID NO: 54621 - DNA, 1138 bp, Homo sapiens
  misc_feature (956)..(956): n is a, c, g, or t
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggnatgggtgctcggcgtgtgcatgcacacgccgagtgtccaaacacacacacacttcctattctgcagggcttcagcgtggccttcattcccgcctcgcctcggcctcttttcaattaagaagtgatgccacttgaggcagggtctgcatgatcacttcttgggtatgggtattcggcgtgtca

SEQ ID NO: 54622 - DNA, 1128 bp, Homo sapiens
  misc_feature (956)..(956): n is a, c, g, or t
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggnatggagcataacaagatctgaggcacctcaaccggataagaaggacgacgcaacgcagagcaggagacgagacaggaggactggatgaagatgggagccgagagaatctgggcgtcgcgacgactccggagccagagagggaatcctcaagaacacagcgatgcgggacccg

SEQ ID NO: 54623 - DNA, 846 bp, Homo sapiens
tacgatcgagctcgtacccgacgttactgcacctgcgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatacacagggcacaacgaagaccatgatgggcattcgagccaggactcctcgggcagatgttacga

SEQ ID NO: 54624 - DNA, 684 bp, Homo sapiens
aagctcaatgctaaaccttttacaaatatttctaatcctcaatcataattagtactttcattttatagaagaggaaactgatttgtgtaatttggaaattacccaaaaggtagtaatgggggtactaggcttcaaatccaggtctgcctgactgtaaacttcatgctctaaaagcaatttgttaaacacttttagcctaaagaaatctaaccaaattacaaagtttagacaaaaacagtctttatcacaagaaaatgacttaacgatacaaagtatctcaacaagtcagaagtatgctttggatttccagactcagatctaggtactcccagcactggtgctgctgctgcctctcttttttactttactttttttctttaaacccatttctgcaggatgctgcctctttctacgctaattcttcccagaggagtttcatactacaaacgacaaagacattgtctaaagcattacagaaattccttcagtcttgcctctgacttatcacctaaatttgtatcgttaggatgaaaggattatccgctataccttaatcatgacgctatgacaacaaaaagttatggtggatccaaggttccaattcagctggtcccacacagtaaaaccaatgcacacttccagtctctttgttgctgttctgataaagcaattaaaaaccattca

SEQ ID NO: 54625 - DNA, 337 bp, Homo sapiens
cccgcggggtaccagtttcctgctcctccctggctgggcgctcagctctgggctggggaattcagcctgactggttgtccaggaagatgctgtctgggcttcccagggtgacccagtatctccctgagcagtgtgcctgtcacagctgcctccctccctgtgagtaccggaacaggcgtgactggtagggcctctgcctccttggggccattgtacctgctgctgcccgccccaccctgctccctcctggcaccatctcctttgcttccccaaggtccctgtgggcacacaaggcaaggaggccaggaggagccaggtgccagaccccctccatccc

SEQ ID NO: 54626 - DNA, 451 bp, Homo sapiens
tttcagttcttatcaggaaactgcatagactttcctctttatgtatgactgagggctttttaccatcatttgttcacttcacagatatttatttggtatttactatataccaggcactcttgtggcagtggaaaatacaactctcgtggaacatctgttccagaaggaaagactgccaataagcaataaaataggcaaaagatatagcatgttagagagtggtaagtaccacagagaaaaataaaatggagaaaagaaacacgaaaagttggggagagaggacaactgtttgagggggtggccaggggcagcttcatctcatcaagggggtgattttttttgagtacagacctgaaggtaacgagtgcacaagccacatgggtacctgagaacagcggcagaacaatggcagggtgctgggagggctatttaccacccatgctgtttagaa

SEQ ID NO: 54627 - DNA, 1324 bp, Homo sapiens
tatcgagtttatatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggcgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttataagtctttggatgaggatgacctaggtcctagaagggtagtt

SEQ ID NO: 54628 - DNA, 864 bp, Homo sapiens
gtctgggtaacagaattaggccaatttatttaattccatttgttcatgtatccagccaacagatatttatggtgcacttgttgggtgccagccccgcccccaccactccaccctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtgagaacacttgcagtcctcggggtggaaatgccttctagaaatactaagtatccgttctctcgttgagactttggcaaaccagggattttaggaagggtctggcactcaacgttcctaaaattggtttcctagatggagccggagggagagagggagtcaggaactgctgcttttcgtcggaatgcccggaggggagaagaagaaggaggaggggtgagggcgggcggccaaacgccagccggcaggggacccagagaagagggacatcccgggcgaccccgaggagcgcggcttgggcaccgcagtggccgcggctagtgggagacctgag

SEQ ID NO: 54629 - DNA, 2794 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54630 - DNA, 2387 bp, Homo sapiens
ggagatgagcaaggaggccgtgagcctgtgggcgctcactgtgtccctccaacccccagtccccttgtgtgtctgcagagagatgacaggatcaggcagaagaaaacagcaatgtgtaactttgccattcatctccagagaattatgtttttatcttttgctttttcctccccccaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54631 - DNA, 931 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtgagtgtcaggccggcggcggccagcgacgcgatcccgcgcaccccgtcgggggaccgttagcaccctcgcgggcgctgcgcccctgccgccgccccgggggcaacccggccgccgaagaaccctgcccgacgtgcccgctgccggccttaaagggcccgtgaccgctccctgcccccacccgggccgtggggaggctgcgccccttaaaggcgccgcgcccgtccgcccccatcctcctcgcgggggctgccgctgcgggctagggcaggcagaggtgctgcaggagcccttaaaggggccgggaaagtgttcgctggagtacccaccgcccttccgcgggcatcgctacctggcggggggagggggcagctagctgcctcttaaagggatagctctgcccttgggggcagtgactcggccgaggaggactcctagatgtgtccccgggagcttcggggatccccgaggggaccatgcctggtggctgcccctcaagggcgttgggcgaacggtgccgcgtctgcccttcctccccgcttcacttccctttcgggagcccgcgaggctgggtgggggcggggagggcgtctccgtcgggcttggggagtccaagtccgcccgccccttcggccctgtagccagggctggcgctgcacccgggaatccccggccggcacggggccgaccccagcctgcgaactttcgtggggcctgtgccgtccaggtcctg

SEQ ID NO: 54632 - DNA, 907 bp, Homo sapiens
gtctgggtaacagaattaggccaatttatttaattccatttgttcatgtatccagccaacagatatttatggtgcacttgttgggtgccagccccgcccccaccactccaccctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccagtaaggcctttggggcatgtcttcctcttg

SEQ ID NO: 54633 - DNA, 3197 bp, Homo sapiens
gtctgggtaacagaattaggccaatttatttaattccatttgttcatgtatccagccaacagatatttatggtgcacttgttgggtgccagccccgcccccaccactccaccctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54634 - DNA, 2751 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaaaggtgcacagttctgagcaggcctgactcacgtttccttattgctggggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54635 - DNA, 2581 bp, Homo sapiens
catacactgacagggccagaagggctgagatgctgggattgaaccatctttctctttgtgagttgctttccagatagcacgcattccggtcactattttccagagatttaagcagcaaagtgagggaccctcgggcatcgactcagagacctggaggggagcagcttgaagcaatgtaaaaagcactggataaaatctggttctaccaaaaatagggctatgagagttacctcacctccctgaaagtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaaaggtgcacagttctgagcaggcctgactcacgtttccttattgctggggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54636 - DNA, 2122 bp, Homo sapiens
gatgcttagaaagcacaccctctatttgttatcaggctgattacaaattatgtttcctacagtatgagaaattgattatccatttctcctgattaggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaaaggtgcacagttctgagcaggcctgactcacgtttccttattgctggggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54637 - DNA, 1845 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaagatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatcaagccatgctttatagctgcagaatacttggggatctgctgcctgggggttccattggtgtgacagcattggatccaagcagtggatcaatcaccagccctcatgaagagcttgctataagactacactataaataggtttaggaaccagtcatttgttttcatctttgctggagaacttataagcctaggcccatcttaatcgtaaattataaatctgtttatattgcctgatgccagtagagcttaggacagtttaaaggccatcattttggacacaatggcttcctttccccatctcctaaaacagagagagagaatatcaggaatttccataggcaggactcctagggcacaaaccatcaaaagcagggcaaggattttcaaaactgagctcctcggaggtttgttcaggttaccaagagctgtggtgttaccaggtgggatgggcgtggggatagttgctaaggagagagggtaagagtagaaatcctgcttc

SEQ ID NO: 54638 - DNA, 298 bp, Homo sapiens
attccttagagctgtctcttcacaacgtaaccccacttatttcttacgtatttttaaaaaattggttctttcctctaaaaaacagcgatataaaaaaagatagccatgcagcccaaaaagcagcatctcaccctaccattaaatgtaactttcttattaaaaatgtgcttaggaattgcttacttaatctgaagatgctttaaaaaagaaatcactgaccagtctttatctcctcccacaggtgagaacccccacataggtatagacatgattgacaacgaccaaggatcaagtagtc

SEQ ID NO: 54639 - DNA, 2849 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54640 - DNA, 2865 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54641 - DNA, 3362 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaatactgttcacatttcaaataattagaaaagatgatctacgccagtagcatttgtggtgcttttctggccttcataacgattctgggcttgcataatttccccatgctactagcttagctgtgttgttaaaatagttcatttataaattgttgcaattttaatttatgtgagaacaaagatgttactgcttatccacaaacatcgaatcctctgaaattataaattcaagattatatttaacaaattggcttctctaatgctgcacctctctaatactacttcagttatatagtaagtgaccccagtcctaaagcacctaaatatttgatcccttcttgaattggaccacagaatatttagaatagcatttgcataaataatttgctaagcaaagtagcatggtataatggaaaaagcactgaactagtatgagaaactggctctgaaacttagggtgactatatgacctagtaaagtcattttgcccttcatatcaagttggactagaaaatactcttttcagctctaataaatattgttttgatttatagtacattttataatta

SEQ ID NO: 54642 - DNA, 2811 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaagatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaaaggtgcacagttctgagcaggcctgactcacgtttccttattgctggggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctata

SEQ ID NO: 54643 - DNA, 2357 bp, Homo sapiens
agcgattggtgggcggggggccgggcctgggccggcggggagcggattggtcggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaatactgttcacatttcaaataattagaaaagatgatctacgccagtagcatttgtggtgcttttctggccttcataacgattctgggcttgcataatttccccatgctactagcttagctgtgttgttaaaatagttcatttataaattgttgcaattttaatttatgtgagaacaaagatgttactgcttatccacaaacatcgaatcctctgaaattataaattcaagattatatttaacaaattggcttctctaatgctgcacctctctaatactacttcagttatatagtaagtgaccccagtcctaaagcacctaaatatttgatcccttcttgaattggaccacagaatatttagaatagcatttgcataaataatttgctaagcaaagtagcatggtataatggaaaaagcactgaactagtatgagaaactggctctgaaacttagggtgactatatgacctagtaaagtcattttgcccttcatatcaagttggactagaaaatactcttttcagctctaataaatattgttttgatttatagtacattttataatta

SEQ ID NO: 54644 - DNA, 1644 bp, Homo sapiens
accagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggc

SEQ ID NO: 54645 - DNA, 1656 bp, Homo sapiens
gccgctggggataccctggcctgatggagagggtctaagaccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggc

SEQ ID NO: 54646 - DNA, 1595 bp, Homo sapiens
accagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgataaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggc

SEQ ID NO: 54647 - DNA, 1258 bp, Homo sapiens
accagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggttttgtttaggaccagcccagaatgcaatctatcctgtgtggaatggatgggatgagagatggatgggcccagccttagaagcaagatctagacctataagtatagtcaacagaatggagagggaagaacccagacttcaggaacccaatgtagagtcctgcatgaccccttgttcactatcaaactgacttccacatacaggagcacgaaaggcacaggaatggatgccaatagactcattagcacctcctcaatatcacctcagtccacttaactgagaaacagctgttgaagatggcgagatccaaaataaaacccagttctcaaccaaataaaatatctctaaaaagagg

SEQ ID NO: 54648 - DNA, 1900 bp, Homo sapiens
accagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggccaaaaaaaatagaaaagaaagaacaagtgtggggcacgcagaggacccgaaaaaaagtgttcagaaccatcgagtggagcaacgagcgacccaagaagataaaggaaccggggcaatagagtggtaccaggagaacccggggacgagaacaacgagggggatctccgacaaaaaaaaagccacgggaaacaagagtgcttgaacaaaccagaggagagagagagcaaacggagataaaaagagcaaagcacgataa

SEQ ID NO: 54649 - DNA, 1591 bp, Homo sapiens
accagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctgaaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggc

SEQ ID NO: 54650 - DNA, 968 bp, Homo sapiens
caggatgttgagggctgattgagtgaattcatggacccgctgttggtcaaatggtttgacttctgtaattggtttaaatgtgtctttctctgctgctttattcccttagaaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggc

SEQ ID NO: 54651 - DNA, 286 bp, Homo sapiens
attctgcttatcaacattgtatggtaaatacctgtatctcctgtcacttccatgtatgcactctgttctctagcagatttgaaatctggaaacctccctcatcagcacacatgtgcacacatacatgcatacatacaccccatactcttttagagccatcctctttacatgttgtttctgcgttgggaaagtgtacatggtgaacttcttgtggtttactaagaagaatatgattgtaggcatcacaaaaataacatattgtgtagtactttatcaaatgctttta

SEQ ID NO: 54652 - DNA, 392 bp, Homo sapiens
ggggcatagtgcctgttgattcgagcttgataaaataaggccaaaataattcttcccagtggatctttagggatttggttgaggaaaagcttaggaaagtgttctcaaacatgactatgagaatcacttgggagcacttttacaactctaccccagacctgctgaatcaacattccatcggagatatcagaaatctgttttgtaagagctagagaacttgtcctgaaaccagcctgctgagcaagtaactatactggctttactgagactatcaactaatctgtaagagttgactgagataggagtgagctgaagctcagccaagttcccctgagtcactgccactgtcacagaagaaaaaattttgaagcattcacactgtggtgagaatt

SEQ ID NO: 54653 - DNA, 257 bp, Homo sapiens
cacacacaccagcagagctggaaatgaacgcttattcaagcagttctgttacctctgtggagaagtgccatgggaattataatggcaatcagcttccctgctgcaattgaaaagttggttaatgtattggcactaatacagcacctcttcccatcacagcagaattggctgttactgttatagctggattatggccacttctccctcctttgcaaaatttaagtctgtgatgttctcgtcaagggaaatgatgatag

SEQ ID NO: 54654 - DNA, 198 bp, Homo sapiens
ttgacccactctttgagataagttattctgaagctttcatataagtaaaagcaattaaattttgccaccagcaccatcctcaaccattctgaattataaagtgttaaaattaagaacaggaagaatggaagtattcaataaaaaatgaagtattttcagttccatattgtcatcaaataagggtgggaaaggcaaagg

SEQ ID NO: 54655 - DNA, 230 bp, Homo sapiens
caggaagaggaatggcaactactcagccggactcagcagcgggcaggagcctccgagggcacaggtcagggccagggctcagagagtgccatggtgatcgatgaggacttcctgggggcgagagggctggtgaggctgggccagggctcagagagtgccgtggtgattgatgaggacatcctgggggcgagagggctggtgaggttgggccaggcctcagagagtgccgt

SEQ ID NO: 54656 - DNA, 389 bp, Homo sapiens
agttattctccctcctcagcctcctgagtagctgggattataggcatgtgccaccacgcctggctaatttttgtgattttagtagagatgggatttcaccatgttgacagggctggtcttgaacttctgacctcgtgatccactcacctcggcctccgaaagtgctgggattacaggtgtgagccactgcgcccggccctgtgtcttggttttgaatctctctgtggccccttgactgagcgccgtgctgcgtggttgcttagctgcccatgtcgctgatgggctgtaggctccttgggcagtggcgtcatcattcttgtttgcctctgcatccccagcgcctggcacagagcctgacacggaggggccctgaaactgatttgctacag

SEQ ID NO: 54657 - DNA, 300 bp, Homo sapiens
ctaatttttgtatttttagtagagacggagttctaccatgttggccaggctagtttcaaactcctgacctcggatgatccacccgcctcggcctcccaaagtgttgggattataggcatgagccactgtgcccggttactttttccttttttaaaacactgaaattgctgtatctaccacattaacattttatttaaaaaaatttgttaaatagcatatgtatgtaaatttaatattaatatacctctttttttgtccttctttaggtgttggagcctaggatacttacttactgatttt

SEQ ID NO: 54658 - DNA, 290 bp, Homo sapiens
ggagataggaatggaattgatggctttattcttcagaactaccaccgtaggcagccatggcaagcaggggcgcccttgcgttgttcttgaggaaaatattaagtgaggctaaattcaaactgagcctgactccccaacccccacaacccttttatatatatatggcatattacagtgagaatttctttttaaagttttaggtctttgtctttttcttgataaaattatagttataatagttgtcataagttaatcaatcgtatgttttaagtgcccttagtgcaaaattt

SEQ ID NO: 54659 - DNA, 230 bp, Homo sapiens
aatttttaaattttttgtagaaacatggtttcaccatgttgcccaggctggtcttatactcctggcctcaaacaatcctcctgtctcagcctcccaaaatgctggaattatagttgtaaagcactgtgctgagcttataacagacttttatatagcagagttatttccctgttcaaataatttgaaaaaattaaaaaataatctgtatgtttaaaatgtatatcctattt

SEQ ID NO: 54660 - DNA, 368 bp, Homo sapiens
gggacacattcaggccataccacagctggagctaagagagcgtagcaatcattacatgatcttggcctcagcaatcctctgtcttaagtagctgaacagtttagccataggccagatagatgtacatggatattagaactagatagcattatctggccaatattacaacttaatatggtacatattaaggtattcctgttttttgcttagttttatttttcttctctgccttaagaaatctctgtctttcatgtactaacaagttttcaaaacttctcttggatcactctccattattttcagagctttaaagaatataatttaattatgcatatttttaaagtttctcctgaatatgtttaaagatg

SEQ ID NO: 54661 - DNA, 275 bp, Homo sapiens
ctcagcctcccgagtagctgggactaccatgatttattttatccttctttatcattcatcaacaatttgtctgcctgttacaaggagagcacagcaaacatgtctttaggcacctgtgtttagtatcttgtaggatggatttccagatatgatgctgctgcatggatatgaacatttaaaaatattgaaagataatgcccaagttgttcttttaagaaagctgaaccattgacattattactgtcaaggaagaaaagctttgattaccttccacg

SEQ ID NO: 54662 - DNA, 632 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacatctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggtatagagggggaggcctgtctcctaatttaatccatctcaaccagaggagtttattattcagggtccggg

SEQ ID NO: 54663 - DNA, 3914 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54664 - DNA, 2271 bp, Homo sapiens
ccatctctgctaaaaatacaaaaattttttgggcctggtggcatgcacctgtaatcccagctactcaggaggctgaggcacaagaattgcttgaacatggaaggtggaggttgcagtgagctgagatcatgctactgcactccagcgtgggcgacagagtgagactctgtctcacaaaaaaagaaaaaaaacaaaaaaacaagaaaaaaaaccacataggtactgttaagaccctggagcaactatccttcactctatccacactgaattctctgggttttgttatttgcttgcttgttttgcttaggaaaagtatgcagcttaaaatctttatgatgactttagaaagttttggactttgtatatttacagtctttaatgcaaccaaagactaattgacacaggtcatgtgtcaaatggcttaaaataaaagcaagcaaacagcagctgtgtctggtcatgtatagagtatgttttgacttcggatgaagttgatgtttaatagcatgtggaaacaatgtcgtcaatatttcaactttgttttgtccttgcttttcaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54665 - DNA, 2883 bp, Homo sapiens
gagttaagtttctaattctgagtggtggctaaggacccctgggacttttgagggctgtgtcagcaccgtagatggtcctgaaccattgatggtcatttgttctaatatcagaattactcgacctggcatggtggctcatgcctgtaatcccagcactttgggaggccaaggtaggaggatcgctagagcccaggagtttgaaaccagcctggggaacgtagtgagacccccatctttaaaaaaaataaataaatggaattattcagactttttctccttcatcaattctagacattcatgctcttcgacctcaccgtgggcaaattgaagttgcttttcggtttcggtcactcttggactcagatcaccacccatcagaaatagcaggtctgaccatgtttatgggagtgacctatttggttacgtgttttgtgaaaagaattggtaacatgatccctgtctcatcccctccacctcttccacagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54666 - DNA, 2924 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaaggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54667 - DNA, 3862 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54668 - DNA, 2501 bp, Homo sapiens
gttttttcagcctccaaattgggtgtacatgatccacctttaaggctttttgttttttgcttttgtgcccctttatatctcttgcaggaagacttgtctctttccctccacctcacatttgtacacagactgccacctccacgttaaaccttaacctcttttgaaagatggtctttgccaataggggagagacagtttctggaggaaacttccatggtgaatacccagccaaagtaagctttttagaactgctcttgacccagaaggcacatttcaatataggctgactaaatggagaccctctttcaggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54669 - DNA, 2054 bp, Homo sapiens
  misc_feature (15)..(15): n is a, c, g, or t
gtgagactctgtctnacaaaaaaagctatccttcactctatccacactgaattctctgggttttgttatttgcttgcttgttttgcttaggaaaagtatgcagcttaaaatctttatgatgactttagaaagttttggactttgtatatttacagtctttaatgcaaccaaagactaattgacacaggtcatgtgtcaaatggcttaaaataaaagcaagcaaacagcagctgtgtctggtcatgtatagagtatgttttgacttcggatgaagttgatgtttaatagcatgtggaaacaatgtcgtcaatatttcaactttgttttgtccttgcttttcaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54670 - DNA, 2218 bp, Homo sapiens
ccatctctgctaaaaatacaaaaattttttgggcctggtggcatgcacctgtaatcccagctactcaggaggctgaggcacaagaattgcttgaacatggaaggtggaggttgcagtgagctgagatcatgctactgcactccagcgtgggcgacagagtgagactctgtctcacaaaaaaagaaaaaaaacaaaaaaacaagaaaaaaaaccacataggtactgttaagaccctggagcaactatccttcactctatccacactgaattctctgggttttgttatttgcttgcttgttttgcttaggaaaagtatgcatctttaatgcaaccaaagactaattgacacaggtcatgtgtcaaatggcttaaaataaaagcaagcaaacagcagctgtgtctggtcatgtatagagtatgttttgacttcggatgaagttgatgtttaatagcatgtggaaacaatgtcgtcaatatttcaactttgttttgtccttgcttttcaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 54671 - DNA, 3270 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggcaagctggctccttggcttgtttcttaatttttaattgttacaggaaagcaaagtcggggatggagaaacattgccttattctattgttttctggccattccttgggaatgagcaaaaaggtatttgagcaacaacttgcagcaccactaagaagccatataataaacactaagtgcaccagggtgcagccaacggttgaatatctaaggattagaaacagaaatggattttaaatggagttttgggacaatattcatggggaaaaaaataagatgtcaggttcattgatgcctccccacccctgcaagatgtcctctttgattcaaaagtgcgttcccttctgggtgatgctatcacaactaccaccactgggtgcaatggctgcgtagacctggagagaaaaccaaggcccgggtgtttacttcagaagactttcggtctgtctagtgctctggtgagatgcgggtttttctttcttgcatatttccactggttacattgaccgtatactcagctgccaggtacagatgcccagcatgctggcttatcttttaaatatcgtttttgaagtgctttaaaccttttgaataacttgtgggtgttatgttccctagaatcgcttgatttccttaaaacagttgctctgctctggggcagtgatttttccctgtgattttcacacccattatttctaagcatgccctgcactctggatggggaagctgcttgcctgctgccaactttggtgctaggagggaggtatacgagaggttagcctttaagagtattcatttgctaaggtcataaaaaataataggaaaggctccttggctgtcagtggcaatcagttaaaaagcagatataaaccaaaaacagggccttaatttcattcaatttaaaaaaaaatttttttggagatgcgggtcttgctatgttgccaaggctggactcaaactcctgggctcaagtgatcctcccactttggcttcttgagtagctgggactacaggcacatgccaccatgcccgtccagggccttactttgagatgatgttatgcttaagaa

SEQ ID NO: 54672 - DNA, 2446 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcaggtctgaccatgtttatgggagtgacctatttggttacgtgttttgtgaaaagaattggtaacatgatccctgtctcatcccctccacctcttccacagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctgtatcttttgattgtatactaacctgcaattatagaattgcagctggtaattttaggatctactgaaacaatcattttgtgtagctttctcagttccattgctccatttcacagagtaaatgaatcagtacctgaggctcagaggttaactgactttctccaggtcagagctggtaagtggcagaggtgacctgtgaacttactctcaggttccaagtctaacatgctgtactttcaaaatggacctattcaagatttaagaagatatttccagcattggctgacatgtttcctgaagacactggccctaaaacccactgccaaggttgttggtggaagggtgaagacgtgggtcacaaatgtgattgcagaaatgctgaacaatttatgcaggcctctctgctttgagtgagagcagtttgcattatgcagaggtcagccttttaacacttaccaaagtattgattaaagagttatggcttcctcatcctgaggtttttggcattttttttttgtttatttttagacggagtctcactctgtctcctaggctggagtgcagtggtgccatctcggctctctgcaacctctgcctcacgggttcaagcgattctcctgcctcagcctcctgagtagctggaattacaggcatgtgccagcaggcctggctaatatttgtatttttagtagcg

SEQ ID NO: 54673 - DNA, 1909 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaataccataaagcatcatttaatgtatcatccctgatgaactgctgggagcttccctgatagtaagtgaaaggggtagagggccccagaagaggaaacagctaaggaaatagataatccttttggggatgcagcttctagatcatctgtcttccgtgcaggcttgtctttgattatttcactatggacagcgttttcctccgaccaccctcatacagcaatcaccctgacctttctaaacagcaaattcaagcatgttctggtgaaaacttgtaatgcttcccattgtcctcaggataaaggctaaacttaaagtggctttcaagggtcttgtttgtcacattagcccctaatcccttcctatgtgtggttctgcattgcagaaactggaggttgcttggagaaggaatgttctgggcagagggtctggtacaaatacgttcttctctctcctatttctgcttctgaaacatcttctagggatcttttgaagccagaagttcaagaccagcctgggcaagaaaaggctgccgcctctacataaaataattaaaaaattatcctggcacagtagcatgtgcctgtagtcccagctactcaggaggctgaggatcacttgagcccaggagttcaaggctgcagtgagctaggattgaccactgtgctcgctctagcctgggttacagagaca

SEQ ID NO: 54674 - DNA, 410 bp, Homo sapiens
taaaggctaaacttaaagtggctttcaagggtcttgtttgtcacattagcccctaatcccttcctatgtgtggttctgcattgcagaaactggaggttgcttggagaaggaatgttctgggcagagggtctggtacaaatacgttcttctctctcctatttctgcttctgaaacatcttctagggatcttttgaagccagaagttcaagaccagcctgggcaagaaaaggctgccgcctctacataaaataattaaaaaattatcctggcacagtagcatgtgcctgtagtcccagctactcaggaggctgaggatcacttgagcccaggagttcaaggctgcagtgagctaggattgaccactgtgctcgctctagcctgggttacagagacaggtgtctaaaaaataa

SEQ ID NO: 54675 - DNA, 397 bp, Homo sapiens
tccctaagctcttaccctagtggctaatcaaaaaagcctgtttttgataaagctttggtgttttcttcatctgtgtctgaatttcattacagcagcataaagcatcatttaatgtatcatccctgatgaactgctgggagcttccctgatagtaagtgaaaggggtagagggccccagaagaggaaacagctaaggaaatagataatccttttggggatgcagcttctagatcatctgtcttccgtgcaggcttgtctttgattatttcactatggacagcgttttcctccgaccaccctcatacagcaatcaccctgacctttctaaacagcaaattcaagcatgttctggtgaaaacttgtaatgcttcccattgtcctcaggataaaggctaaa

SEQ ID NO: 54676 - DNA, 207 bp, Homo sapiens
gtactcctttcgtatttggctttcttttagtgttgctattctagtgtgtgtttctggtttttatcttcctaccatttatcatttgtacttgtaatttcttagaactcttttgtgttcctccagtttcctggaaaaaccttcgggtcttgcgtcatggcccgagcatcttctgtgtttggatattattaatagccttgttttgcttat

SEQ ID NO: 54677 - DNA, 341 bp, Homo sapiens
ttctgtttcatctttgtactgctttatcacatagttgtggatagacagttcgcctctttggtagaacatctgaagcctttactatgggaactgctcagtttgggaatggcctttgtgatgtagcttccaggtaatttccggagtagggggctgctgggcaggatcccttctgcctggatatcatgtatatttgtgtttcttaccttatggagtgggggttggggaagagtggctgggaaacagtgcataaccctggctccagaaggctggctagggtttgttttccttcttcattcctgccagccctgttagctaggggctgggttgtctgtccaccctta

SEQ ID NO: 54678 - DNA, 446 bp, Homo sapiens
  misc_feature (261)..(261): n is a, c, g, or t
  misc_feature (352)..(352): n is a, c, g, or t
  misc_feature (407)..(407): n is a, c, g, or t
aatttatacctttcatctaactgtatgttcgtacccattaactcaactctcttcatctgtggttccgctcacccagacctttcaatccactagttcctgtcattctactctctgcctttaggaggtgaatttccacagctcccatgagtgaagacgtgcagtttctttctgttcctggtggtttcacctgacacggtcacctcccattccagccacgttgttacaaatgacaggctctcaaaaaaaaaaagggggagggtngcgcaaggagaggacacctctctcctggggcctgtcgccatctttccctcatcaatagctaaaaatgggcaaagaaggaaagagccagggnccccgtggccatcaaatccttccggccttgtgcttgccctgttttcgggcactgnttgcctttagggagattcagggagtgtttcctaggccat

SEQ ID NO: 54679 - DNA, 297 bp, Homo sapiens
actgtcacagcttcctggtacccttgcctttgcctgtcaggtagcacttcggtttggacctcactttttcaggatttgttggaaacaagatcccttatcttctctaggtcagatttggggtgaacttggctgacagtattccagggcaggcagaggtcaggctggctggtgacctgctgcctccttcccatcggcagctagttctagggccatccacagggatccccagccctccatagtaccagtgagcctcactggcatgtgccagggccaagagggccttcagcgtcgcctcca

SEQ ID NO: 54680 - DNA, 309 bp, Homo sapiens
ttcactagagtgtctgcacaggaaggatagggcagctcaggctgctgatctgggtgagtgggtgctccaaatgcctggagatctccctgagtgttgagctgagagggccccactgcaccatgatctcaggagaacagtctagcataccaagcaataactcactcagaccagtccacaggtcaccaagctgaccctggttgcatcttgttgcctaggagaaaccacagctgtagcagtccctttcccaccccagtcctgtgacagggaagagcacattgccagcacctactgcaaggtgctttctacaat

SEQ ID NO: 54681 - DNA, 2569 bp, Homo sapiens
cgccaggaacagcttgaggtacctgagccctgccagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54682 - DNA, 817 bp, Homo sapiens
taggctaggtagaggccgcgtgtgtaatcggccgagggagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgaattcacattcaggacttcttttcacctccatcgccaagtcaaggagcaaagggaaagtgagaacgat

SEQ ID NO: 54683 - DNA, 2760 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54684 - DNA, 2673 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54685 - DNA, 3030 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54686 - DNA, 3195 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54687 - DNA, 2409 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54688 - DNA, 1417 bp, Homo sapiens
gagaagattagcatggcccctgcgcaaggatgacacgcaaattcgtgaagcgttccatattttcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54689 - DNA, 1563 bp, Homo sapiens
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54690 - DNA, 1095 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccgggacttacagttgaggccaggggcctcaagggaattttggcattcccccctgtgggggggaaacaaaggggcaaac

SEQ ID NO: 54691 - DNA, 928 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactt

SEQ ID NO: 54692 - DNA, 1010 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtgccatggcttgtacctgtaatcacagctactcaggaggctgaagcaggaggatcactggaggccaggagttggagaccagcctggatgacagagggagatcccatctctttaaaaaataaataaataaataaataataaaaaaaaaaaaaaaaaaaaaaaaatctcagaggggctttataggtaggggtgggggaaaaagggggcattggaattgggccattggggcataagctgggtttccgtgacccacgagttttcgtgggtaacaaggtgggtaaaaatcggccgggtctccccatattagggaagtctggattaaaattcgcgaataacccgggggtaaaccgtggttaatgacacggggaga

SEQ ID NO: 54693 - DNA, 716 bp, Homo sapiens
cgccaggaacagcttgaggtacctgagccctgccagctccagcagcacccgagagggtcaggagaaaagcggaggaagctgggtaggccctgaggggcctcggtaagccatcatgaccacccggcaagccacgaaggatcccctcctccggggtgtatctcctaccccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 54694 - DNA, 1045 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactt

SEQ ID NO: 54695 - DNA, 871 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgatggggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactt

SEQ ID NO: 54696 - DNA, 412 bp, Homo sapiens
accttttgtttagatagtatgcgtacttggaactaagagcactggctttttttccccaaacaatgtcattataagctgatgtcatttataacaccagagcttataagtaggggttgagtttgcctttctcatcaattaaaagtgaattgcagctgggtgtcgtggctcacacctatagtaccaacactttgggaagccaaggcaggagggttgcttgaggccaggagttcgagaccagcctatgcaacacaatgagaccccatctctacaaaaaaattagatgagtatgatggcatgcgcctctgaagtgagaggatggcttgagcccaggagttagaggctgcagttaactatgatcccaccactgtactccagcctgggtgacagagcaagaacctgtctcttagaagaa

SEQ ID NO: 54697 - DNA, 400 bp, Homo sapiens
ggaccttgttttacattctggatttttctttttactttcctaatgatgtaatttaacttcttcctgtattttccatatttcctataaaatggtagttagatctaaaagcttgatttacttatttcagatttctagtcaagggtactcaatagattgtattttcttttgcctcacacggaggtgcataatgtctgcctggcctgtagtgatgctaaggttgatcattctgttcaggtggcatcagtctgtgatagcttcctgtaagaatcgttcattaacctttcatctaatggttccattcattcatgatctttaactgaatccctgttatttcattagggaatagcaaaataatgattttctaattctgttattcctttcacatttattaactgtaatt

SEQ ID NO: 54698 - DNA, 368 bp, Homo sapiens
aataaaaatggctgtggaacagagcactttggggcatgatagagaattcattttgttgaagtgggatttaggctttttccttttcctttcctttcacgtttgccttctgagctgccactaaattttagtgctttcttttaagcatggagtgtgtatctgtttgccaaaacaggaaactgaaatggtttcacatgcttcatcgactgtaaattccattctggaaatccccacagaaattaaaaccatgatcactgaccccataatttcccaaactttctagatagagctttacatagtctgatgttcttaaaggtgagaaaactgaattctggaatcttttataactgctttaatcctgggtgctataa

SEQ ID NO: 54699 - DNA, 459 bp, Homo sapiens
ggccgttgtccctgctttctctctgcccatccttctttcccagagtcattacaccaaggcacagactggttcctctgctctgagggtgggtccaggcagacatgtggactctggggaggtactgggggccggaaaatagcgggaattcttgcaacgtgtatatcatcctaaaagtgggggttgcctcaagacagcccccaggaactgataagaagggatgaactcccgtactctccagagtactgaagattctcccctccctggaaccagggatgtgaaactggaattctcagatgcctgaggagctcccagtctcaaaggactctggtgtctcacccatccaccagggcggaccttggagagggtgtcaggggtggcagtcttggaaatgtccaggactgggatggtgagaggcctttggaaacagaaatgatttctatttctgtaaacagcaatgtt

SEQ ID NO: 54700 - DNA, 3800 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctccacctagtggctgtccagtgcccattcctcaccttttcccggggaggagagagcagcttctgccacttcccaggtaagcaggaggaggtgccaacagtgttaggcctggcacagtgtctgggctgactgggaccgtctcaggcccacagaacacccctgcacagca

SEQ ID NO: 54701 - DNA, 3468 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgaaaaccaacaaaaaaaagggagccgctcgggatctagaactag

SEQ ID NO: 54702 - DNA, 3115 bp, Homo sapiens
cgaggacaggtgtggtttgtccctgtggaacagatggggaaactgaagctagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54703 - DNA, 3046 bp, Homo sapiens
agggcgactgttgaggatcccccgaggtgcccttaaagaagatcttttaccagaagctgaggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54704 - DNA, 3735 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacgtgagtgggcttgggtggggcatggaaagccacgcaccctgctgctcctctcccgggagctgggcctgtggcttggctgggagggggaggtcaggggatgtctgtcctttagcccccagggccgtggctatgggggtcagggccgggatcccagcatggggaggccggagcaggtaaatatgtggcaaggatggccaggacatgggtatggggaccctggcatggggccagcccctgctgcccaggtgcctctgccccagggctgggcagaggcagcctgtggtgaccgcagctgtcgctgcccctcagctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54705 - DNA, 2709 bp, Homo sapiens
  misc_feature (4)..(4): n is a, c, g, or t
  misc_feature (19)..(19): n is a, c, g, or t
  misc_feature (25)..(25): n is a, c, g, or t
ttanggctaggtagaggcnggggtnaatcggccgagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54706 - DNA, 3331 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaaggggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54707 - DNA, 3366 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggcagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54708 - DNA, 2519 bp, Homo sapiens
  misc_feature (4)..(4): n is a, c, g, or t
  misc_feature (19)..(19): n is a, c, g, or t
  misc_feature (25)..(25): n is a, c, g, or t
ttanggctaggtagaggcnggggtnaatcggccgagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54709 - DNA, 2162 bp, Homo sapiens
gtctagctgattcctgaggataaaacaaaggcgagtccgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54710 - DNA, 1999 bp, Homo sapiens
ctagaggatctctcataggttcgaggatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54711 - DNA, 1609 bp, Homo sapiens
accagaagaggttcaccgcgatcgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54712 - DNA, 2078 bp, Homo sapiens
cgccggctgctgcggcaccaggcccctgcctgcttagaagtgagcagctggctcgggtttaaggaactcaccctggatcacagccagaaagtggcggctctgggattcaaactcaggctggggccgggcatggtggctcacgcctgtaatcccagcactttgggaggccaaggagcgcagatcacttgaggtcaggagtttgagaccagcctggccaacatggtgaaaccctgtctctaccaaaaaataccaaaaaaattagccgggcatggtggcacgcgcctgtactcccagctacccgggaggctgaggcgggaggatcgtttgaacctgggaggtggaggttgcagtgagccaagattgtgccacagccctccagcctgggcaacagagtggagaccctgtctcaaaacaaaaaagaaacccaggtggggccggctgagtctcctctgtctctcgcctcagactacgccctgggcaaggactgcatcatgcatggctacatgtccaagatgggcaaccccttcctgacccagtggcagcggcggtacttctacctgttccccaaccgcctcgagtggcggggcgagggcgaggccccggtaaggagcccatgcgggggtccgggagccgggcttccgggtggctggccggcccggctcttacctgcaccacccatccctggccctgcagcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54713 - DNA, 1426 bp, Homo sapiens
cggacgcgtgggtcgacccacgcgtccggggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54714 - DNA, 1520 bp, Homo sapiens
tggtgagtacctgaggtttgggatttggcagacggctggctcggggagaacctgcccaggctgagtgcatccaggcctcaccctactttccccacaagcccttctccgagttggcagggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54715 - DNA, 1804 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgtgatccccccccgaaggggggtggaccgcgtgcgaagcctttcgacaattgggccctcgcctagggggcgcccagggaccacggttctgggcaggggtctcagaggcctacgggagattccccctacattctggggggggcgccagg

SEQ ID NO: 54716 - DNA, 1670 bp, Homo sapiens
  misc_feature (1606)..(1606): n is a, c, g, or t
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgagggctcaggaggtgacagagccccttttcngtcctggactgcaatgcttctgcagagtacctcccggtgatcccagagggaagtaacggcgacc

SEQ ID NO: 54717 - DNA, 1545 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggcgtggagtgccgatcttttcctgaaatagtcctggtggagggtgtgcggggggtgttccggggatgg

SEQ ID NO: 54718 - DNA, 1802 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagatggccgccaacatgtacagggtcggagactacgtctactttgagaactcctccagcaacccagtacctgatccggagaatcgaggagctcaacaagacggccaatgggaacgtggaggccaaagtggtgtgcttctaccggaggcgggacatctccagcaccctcatcgccctggccgacaagcacgcaagggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgactgctaaaagaaggcgaggaggatggccgagaccagtccaggtcggagacccaggtgtgggaggcagcacaacccactcacagacaagcagatcgaccagttcctggag

SEQ ID NO: 54719 - DNA, 1005 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccagtgcagccaaaagcagcttcatccaccaaggcatccgctgaagaccaacccctcgcctcagttgttttttatttttctaataaagtcatgtctcccttca

SEQ ID NO: 54720 - DNA, 894 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacgtctgaccatgaacgacttccagcgtgcttcgccatcatagggctcgaagcgctgttgtgccgaggtgctaataggctcccgagggttt

SEQ ID NO: 54721 - DNA, 831 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggattttgccagctggaagaactgtggacgctcaacgatcctccatgtccactctccaggcggc

SEQ ID NO: 54722 - DNA, 380 bp, Homo sapiens
gtgagtaccctggcgccttgggcatgctgctggctgtgcccccatgaggacaagggctgtgtcccgtcacctggaaccccctccaaggtcccagcctccttggaggagctcataagttggggcatggccagccctgtccaatgttctcagagtggaggggctgccctgggagttggagctgctggaaccagctagtaactggcttccagaggggcccttgtcacagatgatgatgatagcagctttttatgtttatcaaacatttattaagcactgggcatagggttgcaaaatttaccagtgttaaaacccacaaccctacgatgtaggaacttctgttctcccatttgagagatgaggaaacagctcaggcttaagga

SEQ ID NO: 54723 - DNA, 428 bp, Homo sapiens
ggccaggcaggctggggagagccccagctgacagagctgggcttggcatgtgcagagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcag

SEQ ID NO: 54724 - DNA, 3426 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54725 - DNA, 3184 bp, Homo sapiens
acgggctggcctccttcctggaggggtggcgacaccaccacagtgccctcagctcgcgtttctgggcctgcagcccccacgggctctgggggcttctgcttactgcgcccccctgacccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54726 - DNA, 3517 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccggtaaggagcccatgcgggggtccgggagccgggcttccgggtggctggccggcccggctcttacctgcaccacccatccctggccctgcagcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54727 - DNA, 2862 bp, Homo sapiens
tcgagctcggcctcgcttactacgtgctgaaggagctgctggctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54728 - DNA, 3260 bp, Homo sapiens
ccgtcagcactcctggggacgtgtccggaaatcatgagagcaggaagccacggccaggtggccgagggccatgctgggcacccaagcagccctgactggtgctgtgggcgggcaggccctcaacatatccttcctggaagaggacattaacgctcgtgatgtttccacacctaccctcacgggaccccagggagtggcggctgggtggggaggctcacgacagcatcatccttcccacattctgagtggcccctgagccctgattcttcttttccagccgataagttcacacggttttgccagtggaagaatgtggagctcaacatccacgtgagtgggcttgggtggggcatggaaagccacgcaccctgctgctcctctcccgggagctgggcctgtggcttggctgggagggggaggtcaggggatgtctgtcctttagcccccagggccgtggctatgggggtcagggccgggatcccagcatggggaggccggagcaggtaaatatgtggcaaggatggccaggacatgggtatggggaccctggcatggggccagcccctgctgcccaggtgcctctgccccagggctgggcagaggcagcctgtggtgaccgcagctgtcgctgcccctcagctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54729 - DNA, 3196 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtggttggcgcaccctcccctcccgtctactcattccccggggcgtttctttgccgatttttgaatgtgattttaaagagtgaaaaatgagactatgcgtttttataaaaaatggtgcctga

SEQ ID NO: 54730 - DNA, 2620 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttcccctttttaaaaaataaatcgctgacaagtgtga

SEQ ID NO: 54731 - DNA, 1686 bp, Homo sapiens
gtggcatcgataaacaccggtgtttatcgatgccacctccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54732 - DNA, 1987 bp, Homo sapiens
cgccggctgctgcggcaccaggcccctgcctgcttagaagtgagcagctggctcgggtttaaggaactcaccctggatcacagccagaaagtggcggctctgggattcaaactcaggctggggccgggcatggtggctcacgcctgtaatcccagcactttgggaggccaaggagcgcagatcacttgaggtcaggagtttgagaccagcctggccaacatggtgaaaccctgtctctaccaaaaaataccaaaaaaattagccgggcatggtggcacgcgcctgtactcccagctacccgggaggctgaggcgggaggatcgtttgaacctgggaggtggaggttgcagtgagccaagattgtgccacagccctccagcctgggcaacagagtggagaccctgtctcaaaacaaaaaagaaacccaggtggggccggctgagtctcctctgtctctcgcctcagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54733 - DNA, 1437 bp, Homo sapiens
tttctataggggctaggtgaggctgggtgtgtcaccatccctggccctgcagcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54734 - DNA, 1766 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccccctccccccggctggatccccccccaacgagaggggtaagggtgaaactgccgggctcgaaccccccttttttgaacaatttgtgggcttccctttctggttgggaggggatgggt

SEQ ID NO: 54735 - DNA, 1254 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54736 - DNA, 1505 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54737 - DNA, 1326 bp, Homo sapiens
gcggcggcggcggcgccccgactgcagtcccggcgggagcggagccgagccggggccgggcccgagccggcgccatggggcggcgccgcctgtgagcggcggcgagcggaccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagggtgagcgcccctgctgtccccaggctggacctccgtggctgtcctctccttcctctcgacatcccggccaccaggcccagaggagtggggctcctgggacatggccgccccgtatctt

SEQ ID NO: 54738 - DNA, 560 bp, Homo sapiens
aggatgttggctggcttcaggtcccggtagaccacgaagcggttgtgcatgtgctccaggcccaggatgatctcggccgcatagaagcgcatgtcagcctctgagaagaccccgtgccagccaacatccttctggacgagcatggccacgtgcggatctcggacctgggcctggcctgtgacttctccaagaagaagccccatgccagcgtcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 54739 - DNA, 311 bp, Homo sapiens
atccctctcccttcttatcacctgtgagaccctgtgccagccctgccagcttgtaggcctcagttcctccttggccaacttccctggggggtggcagttgcactgaccatccctacccagggccctgggtctgggcagcctgtggctgatggtattccggcatctctgtccacccatgtgcccctgccccatccacctggtaaagttactggacagtgatcaggagctctaccgcaacttccccctcaccatctcggagcggtggcagcaggaggtggcagagactgtcttcgacaccatcaacgctgaga

SEQ ID NO: 54740 - DNA, 483 bp, Homo sapiens
atcaagaagtacgagaagctggagacggaggaggagcgtgtggcccgcagccgggagatcttcgactcatacatcatgaaggagctgctggcctgctcgcatgtgagtgtcctcagctggccctgtgtgctggcccagagtcacctgcagattgggaggggaagagaggaccctgctgagaattcatggccacctctgtcttccccagcccttctcgaagagtgccactgagcatgtccaaggccacctggggaagaagcaggtgcctccggatctcttccaggtgtgtgcctcccggtccctccccaggcaaggtcaccttggacagcccctggtcaacaagcctggtcagccaggggtggggcctgggcaaccacggtctctcggggctcagtcaccaacttccagcttcctcccttagccatacatcgaagagatttgtcaaaacctccgaggggacgtgttccagaaattcattgagag

SEQ ID NO: 54741 - DNA, 201 bp, Homo sapiens
cagagccctagcaacagccctatagagggagggttctaggtatggggcaggcatgagcactgcttataaccaagcaaaacactccctctgtgccaacataggtggggcaggtcacgctggggtctgtttgccctgtctgcccgctgcagcctcctcggggagggccagggttgtctgtgcatcctgtgagccccagggtct

SEQ ID NO: 54742 - DNA, 142 bp, Homo sapiens
accacaaccagcctatacttgtgttacaaggttgtgtttatagagtttatcatcaaagtttgcgaatgaaagcaaatatgtgtgttatgaaacattttaaattataagcattctgtaaggataaataaagttgcgatgtgta

SEQ ID NO: 54743 - DNA, 591 bp, Homo sapiens
gtcccttaaattctgatcatgtaggacattcttctttgccctgggcctgggaaaatgcagcatgttccagagcaaaagtcctaatgaggggaactaaaccagtgggacccaaaccaatgtcctggctcactgaggacccgttagaaccaaatctctgggtgtggacaggctcccatacttttcaaaaattcccctgatgactaatgaacaaccagaggtaagaaccagtggcccagaggaataaccagcccagctgttgtacgagctcgctaagctggctcaggtcaatgttgaattctctgctaggcagctcctcataagaactggcagagatggttcttacacaacaacaggtgacaactccagactctgccggaagttccaggatctgggttcccggacaatgcatgacactcagtccagcattgcaggtggaagagcgacggtgaaaagaccaaagtcaattaaaatgtgttaaccaaaacaggaaacatgagtgaggtgattgagagtgtgtttaacttagatgtgtgattttatcaatactttcattgttcaaaaactcttattttttaaagatattttcaaaac

SEQ ID NO: 54744 - DNA, 538 bp, Homo sapiens
ccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 54745 - DNA, 334 bp, Homo sapiens
agttgaattggaagtcaaaaaaatgagcttaaacacatttaataacatcattctaattaacccatttaacctattaaaattaaaagtttcaataataggcatgatgtataatgaaatatttcatctacaggatggaaacttcttatactcatggctaaaatgtaaaagaaggaaaaatagaagtaagaaagcaagatttatggtccagaataaagatatacaaggattattatgatctagtattgttttaatgaatctatatttctgacatttttctctaaggaaagaaatctcagttattcataaatatgaataaatttgtgaacttaacctg

SEQ ID NO: 54746 - DNA, 390 bp, Homo sapiens
agttgggaagaagcctgactcttgttgagtgagtctgtggaccgggcactgtgatgggcagtgtgcgtgcacaacgtcacttaatccttgcttaacccgtgaggcgggagctgtcatcgacccatttcatggatggaacagctaaggccaagagacatgaagtgacttgttcaaggtaacagcaaggaaaaggcaacaccactgtccgaacccaaaccatctggctgcaaaccacagcttcggagtcctgggggcccttgtgaaatatgtttgttgggtagccccagctttctgatcaattaaacagccaggcactcacccccctagcttgctacattctaaaatacctctccctcccttccctggtcccatgacttaaacggcaaagct

SEQ ID NO: 54747 - DNA, 928 bp, Homo sapiens
taaaaaaggatccgcttttggataaaggtttgaagggcagtcttactgatgcaatgaacatggtcacgagctccaaggtttttggcctgaactcctataggatgagagtgccatttgctgggagttaaggggatgtttttgagggcagtgtggggtgagatcagaagctgtgttttgaacatgttaacctgtaaggcaacctatgagtagtctgtggagttgaggaaaaatgatgtgggctgaagacacaattttggaattcagtgcttaaagtcattccacttggtaagatcacctggcactgactacagatggtgaggagaggttcgaaggttgagatctgggacattctgctgaatatgtattgagaacttgaggaggaactcgtaaaggagatggagaaggagaggcagatggagaaccagtgtagtaggtgtccaaaagccaaacacaggaagtgcttcagaaaggaggggaactctgtcaaatgctgctgatacactgagtaagaagagactagagaacagatcatcatattatgcaaggaaaagatcagaggtgacttccacaagaaggttaattcccactgtcgctgccttacctagactcctgtactagtcctgcaactgcactcttttgctctagtactcctgccattcaaacatgtcctctatattacttccagtgtttgtttgttccctccctcccttcctctttttttcttttttgagacggggtcttgctctgttgcccaggctggagtgcagtggcttgatcgtggttcactgcagcctcgcctcccagactcaatctatcctcccacctcagcctcctgagcagctgggattgttaaaatgagtattaccatttatattctaaacttaattttgacaggaataaaattgaccagtttcactgtttgacatgt

SEQ ID NO: 54748 - DNA, 465 bp, Homo sapiens
agatgcaacctattgataatagtttctaatagaaagaactttaaaaattcttttagttctgtgctgcagtaaatatagagcctaaaatacagtatagttttgggtatacagtaactaacatctattatttccttctaatatatttatttattgatattattcattgtatatatttttaactggataaacatcaacatttatgacaggaattttccatgctggggaatttctcattttgatgtttttattaattgctaactcttgtgggatttcttttttcaagtaggacttatttcagtagtttcatggaaaaaaatcttagaattgtactgttgattttcagtaagtaaagataaatcttcctttgtctgctttacatcatgtacattctaccctttaagaatgagttccatttctttttaagtgagatttaagtaaaactgcatggcaaaatgaagatactgt

SEQ ID NO: 54749 - DNA, 314 bp, Homo sapiens
tatggaatacatgtgatattttgctaagtgcatagaatgtgcggtgatcaagtcagggtatttcctcatgttctcacttataactgggagctgaatgctgagaacacatggacacatagagggaaacaacacacaccagtgtctgttggagagtggagggtgggaggaaggagaggatcaggaaaaataactaatggataccaagcttaatacctgggtgatgaaatcatctgtacaacaaacccccatgaaacatgtttacctgtatgacaaacccacacatcctgcacgtgtactcaatgaacttaaaagtt

SEQ ID NO: 54750 - DNA, 785 bp, Homo sapiens
taaaggtttatgtaagttttgatatctggaaatcttaactctcccacttaactcttcttcagaatttccttgactatttttggtctttgtatgtccctatgaagtttaggatgaacttaccaaattataggaccaactctttagagattttgactagaagtgatatgtgcatccttctttttctttttctttttcctttcttgagacaaggtctcactctgtcacccaggctggagtgtggtggtgcaatcacagctcaccacagcctccatctcccaggcttaaactatcctcctccctcagtcccctgagtagctgggaccatgggcaggcaccaccatgcctggctaattttttatttttttgtagaaatggggtctcactatgttgcccagactggtcttgaactcctggactaaagtgatctgcccactccgaactcccaaagtgctgagattacataagcataagacactgtgcctggccaatgcatcctgctttttctaaaccaccccaagtcatttttggaaaaagacagaagacagataatataacaatagagaaaaatatatatatataactagaaaaaatactggtgttactaagattatttctacttttatttttccaagttttaaattttattataaatatttacttcatgggaaatatatttagagttttaatttttattataaagaaaatatagatagaaaccaaagtaatgaatatactttaaataattcagacctcaagatccatatgaattacctggccagcctgaa

SEQ ID NO: 54751 - DNA, 302 bp, Homo sapiens
ggtccatggtcttcagattctcccagaacctaatttaaagctcagatactcgtatccccacccccaggactttgatttgatgggactggcgcggggtccaggaatctgcactgtgatgctctccccgcagagtgcgctttgcgcctggcaggaggggctcaaagatgtgtctgtcaagtgaacgaactaacaggactcatgagggactcagctttgactacggtgggcaggcctgcagcgttcacattttcccgatgatttctgtgtgggctggactcccccgcccgccgacaccagacaca

SEQ ID NO: 54752 - DNA, 373 bp, Homo sapiens
agaggacggaggctagcgcgggagcaatctctgccatgggacttggggtcccctttatcccctcagaggaacagcctgagtgcagccgctccatcctcagggtgtcggggacattggggccctccagctcccaaacatttgcgccatggtgaggtgacggtttgcagacagggctgcttctgcaggagcttaaactccaggagaacagggagtggtctgaatgcctgggcaccccagcacccagcagtgactgagctgtggctggaaggagagggggtggatgccgagaatcaaggacgggtgcagttcttagtcctctcctctaagttcttcagactgtgggcccgtgaacttgtgagccaaggagagtcct

SEQ ID NO: 54753 - DNA, 595 bp, Homo sapiens
tatgccaccaggcaggagccaacagcaatttaagctccaacctggctcaggccaggcctcctgagctagagggaaggaaagctgcaacacctcggtgtactcacacgacgttcacaaaagcaagcagggctgatgggcaccccccagcccctgggagctctgctcatgaccgctcacagggtaccgagtctttgccttttgtgtgtgcgcatgctgccctcttaactgcttttagtattcagaaaggttccatttatgttttactcctgaaagtgaaaccctcttaggcaacttgtttcatattctgggcattttagtagctacagtattttgcatttaaaatgtaattactcttagtattgtacagccctataatgtatgagaactagtttcacatcctttgaaactaatctctttcattggggaggatataacttttgactttacacaggtggactttgaatccatttttatagaatttttttccactgtaacttgacctatattatgcaagaaaatcccaaaaatatgttttaagggagactacacagaccttgtgatttggtctgagctagttgctgagttgactggagcc

SEQ ID NO: 54754 - DNA, 342 bp, Homo sapiens
cacagttccacagactcgtcctcttcccttccagccatgttctcccctatttctttttcttttgagacagagtcttgctctgtttcccaggctggagtgcagtggcagaatcttggctcactgcaacctccacctcccaggttcaagcagttctcatgcctcagcctcccaagtagctgggattacaggtgcgcacccacgctgggctaatttttgtatttttagtagagactgggtttcaccatgttggccaggctggtctcaaattcctgacctcaggtgatccacccccttcagcctcccaaagtgctgggattacaggtgtgagccactgctcccacc

SEQ ID NO: 54755 - DNA, 200 bp, Homo sapiens
gggtgctctaggcacccccagtagaacctggatatccccactcccaccaagagggcctgatgtccccgtacttagcgtggtaggcatgatctgtgctccgggcctggggtcctagccttgaaatcactgtctgccttccagggtggtctagaagcccctattagggactcaatttggggagttacaggtcgttgcttctg

SEQ ID NO: 54756 - DNA, 292 bp, Homo sapiens
aaattcagaggcaatgacacagggacttggagagacagtgtggaaaaataagcccatggtgggcttattttaataaatacagcagattaaaaggtgactggttcctcctttcttgttcatataagaggcaccattttgtaatgctggcttatagcatttccaaacccaattttattttttccatttttatgaaggaggtgttttcatttactgggaaaagagctagggcaagtaggcctccagccatggcaggtaatattctaggtttctatgaaataagttggtgcatgaa

SEQ ID NO: 54757 - DNA, 703 bp, Homo sapiens
acacgcggcgccccattaaagcggccgtcccgggcgcgcgcctcattcgaggcgacgggctccgggccctgatagatggggtgcggggacggagacaaatgacggcctttgggctcggaatacccacctttctggtaatgcagcccagcgggtcccagcctcgttttccagccctcactcaaaatggagtcgctctggttcgaacgcctctgacaagtgtgtacctacgtgtcagggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcattt

SEQ ID NO: 54758 - DNA, 799 bp, Homo sapiens
acacgcggcgccccattaaagcggccgtcccgggcgcgcgcctcattcgaggcgacgggctccgggccctgatagatggggtgcggggacggagacaaatgacggcctttgggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcattt

SEQ ID NO: 54759 - DNA, 847 bp, Homo sapiens
cgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaagttggagtgccatggtgtggtcatagcccactgaagcctcaaacctctgggctgaagccatccttccgcctcagcctcccaagtagctgggaccataggtgcatggcactgtgcctggcactgtctgaatgcatacagctgcgtagcatcgtggtaagaacacccgccctgacatcacacagacctgcatccacgtcccagctgagcctcagttctcacatctgcaaaatggggagaacaacagcagcagcgtcctgaggctggggtgaggaccgagtgaaaaacctttgtcgcatctttgggcatcgcaggagttcaataaatgttagctatcgttgtcactttgtattat

SEQ ID NO: 54760 - DNA, 673 bp, Homo sapiens
cgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagcgcttggataccatgagtgggttaatgtatgatacctgatgcatgcataaaaacctgacaggtactctaaatcggggacctatttgcttgcatattcaa

SEQ ID NO: 54761 - DNA, 750 bp, Homo sapiens
cgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcattt

SEQ ID NO: 54762 - DNA, 782 bp, Homo sapiens
cgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaagtaagtatggggtttgtgtaaattgcttggtcaggagggcgggacctggggtcttcactaggcttcccaaaaactgggttgagcacatagtaggtgctcactaaataactgttgaaatagataagcaaggagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcattt

SEQ ID NO: 54763 - DNA, 139 bp, Homo sapiens
aaaaaacctaatcttttgctatctccatcttgttgatcatcttttcttatccatattttaaaaatcttagtcaacaaaaattattttcagcaaatatttactattttaagtcttagaaatcaagaaaaaagaattaaat

SEQ ID NO: 54764 - DNA, 373 bp, Homo sapiens
ccccaattataagtataatttagttgtacgaatgatgcaagactgtttgttttaaaaaaatcacaccaggccgggcgtggtggctcacgcctgtaatcctagcacttcaggagaccaaggtggtgaggccaagagttcgagaccaacctggccaacacagatccccatctctaaatataaaaaaaaataataataataaatcatactagaaatagaaaatgtatttttgataaattgaaaactatagatcataagcaaactagcaacggcttaattttccattttctgttaaatgttttgttatgcactgacattagcaacattaatgttgaaagcttacttgtctgtttaggctacctcacggcatctcaca

SEQ ID NO: 54765 - DNA, 445 bp, Homo sapiens
tagactcttctggagaggcattctgtggaaagaacaggcccctggtcaacttagattccacttaatggagaaatgtttcagacctctcacaagaaaaagacactagagctgaactcgcgcaggtcagtgcctgtcagtgaagaagaaagagagcattgaataagatttttaaagagtgctagggtttattgtgcacaggtaagttgccctgttgacctgaagtctcggttggtgggtcaggtcaccttcaagatctgggaggactgctgagtgtggacttcatgtttgaagttctcatcacgcaggaggccggcccttttggatgagctcaggtccgagtcagaagaccccttctgtgttcgcaaaggagaggtctcagcagacagtagagagatgagtaatgggcatgagagtgtcggaagcccacagacgattctcagagcag

SEQ ID NO: 54766 - DNA, 434 bp, Homo sapiens
tggtcgatctctagcaggatcccttcgattggcgggcacttagattccacttaatggagaaatgtttcagacctctcacaagaaaaagacactagagctgaactcgcgcaggtcagtgcctgtcagtgaagaagaaagagagcattgaataagatttttaaagagtgctagggtttattgtgcacaggtaagttgccctgttgacctgaagtctcggttggtgggtcaggtcaccttcaagatctgggaggactgctgagtgtggacttcatgtttgaagttctcatcacgcaggaggccggcccttttggatgagctcaggtccgagtcagaagaccccttctgtgttcgcaaaggagaggtctcagcagacagtagagagatgagtaatgggcatgagagtgtcggaagcccacagacgattctcagagcag

SEQ ID NO: 54767 - DNA, 382 bp, Homo sapiens
ctgcccccagctttcctgaatggagagcgtgcattcatttcctaatatgccacgatccttgggaagatttcttttgctttagtttgctgtcaggcctggaagggaaggtgaagtggggagtcagtgaggagggggctgggccacctggtgggatgttgggaactattttctgtgcagaggccaaggctggggctgggggtgggacacatggaaatcaaacatgtacttcacagtttggtcctgggctgacctgtttataataaaaacatttggtttgacttccacagactccaagccatgacgtcaatgttgatgcatttcaggccacattccttttagtctccggagaagttctttacaaaaagcatgaaaggtggaatca

SEQ ID NO: 54768 - DNA, 207 bp, Homo sapiens
cccagctgggaggaagtttaataaatgtaataaataattgccaaatgaaaaaacaattacatctgcttcttccataagaagcaaaatagagagagttggatgacagaaaatccagaccactctataatgtaaagggaattctttcacataagatatgatacttatgttaatcctaaaggctacatatgattagaaagagagagaaag

SEQ ID NO: 54769 - DNA, 364 bp, Homo sapiens
gaccccaggtgatctgcccacctcggcctcccaaagtgctgggattacagtcgtggccaccacgccagcctcacatttaaaatcttcatgtcaaagcatttgtagtctcctctcactcacttgccagatttatggaaatctatttatggcaaaggaaccacaaaacatttgtttttttttgttgcgtctttttacaatcccctagagaagctcactttaaaaacatatttattttgatgaaactaaggttccaatcagtatggttttttttgagacagggtcttgctctgtcacccaggttggagtacagtggcgcaatctcggctcattgcaacctccagctccaaggctcaagtagttctcc

SEQ ID NO: 54770 - DNA, 305 bp, Homo sapiens
tcagggttcctccctgtgggcacattttctcccggtctagaggatggagtgtaaaaagaatggctgtgcttcagtcaggagcaggccgaggcagacatccagtacagcatgacacagcgggtctagagcacaggcacacaactctgtgcattatgtgatcatatttatgtagccatttaaagtaacctgtttgtgtgagcttatacctggctttgagccactattgtctataagtcatataactgcactgctgactctgtaggagagagagagaataaagccatgtcccaactgcctacggtccc

SEQ ID NO: 54771 - DNA, 345 bp, Homo sapiens
agtagaggccgcttgtcaactcctagtcccgacaagagggaagcttaaaaaggctgtttgtagtcctatcgaccgttttggcacgtagacactttagttttcgtgttacaggcatgattgttgtgttgtactcccttaagcctaatttaaaataatccgctagtgactgttagttttcaagggctccatttgtttcgctgattaataatagactggtattgtggtagtttgggtctggtcctatattagatttttggatttatccctccggtagattgttctggttgttggatgtgttcgcaattgccgttgtatttgtaaactttagagatgtcacataagatc

SEQ ID NO: 54772 - DNA, 364 bp, Homo sapiens
acagattactcaggcattgtggaatgttcctgtagtctcaggaagttggaggctgacgtaagattattccttgagttccccaggaacttgaggctgcattgagctataatcatggtattgtattcctgtctgggtgagagagtaagacctctttttagaatttcaaatttattttagatttaggaggtacctacacaggttttttacatgggtattttgcataatgctgaggtttgaagtatgagtaattccatcaatcaggtagtgagcatagtactaagtagacagtttttcagttcttggtccctccctctctccaccctctaagagttgtctattatttttgtttttctgtccatgtgta

SEQ ID NO: 54773 - DNA, 232 bp, Homo sapiens
ccttatgggttctgaggaccacaatcacaaaccctccatcttcctcaacctcccatttcatctctatccaccactattgatgttataattattcctttaggagacaaatgtattattctcaaactattatttataacaagatctaaattggagacgtccagtttttctgggtttttttctctctttaagactagtcaagtgcagcagtgagaagaagagaaagagaataatc

SEQ ID NO: 54774 - DNA, 386 bp, Homo sapiens
tcagacttaaggtggataggaagtggggacatgtgtgtcttgtgatcaatcaggagttggttgtcccatcaacagaaacaggttaaaataaagccccagggccccggctggaactaccaacctttctattaacagcagaatgctctaacgaattgcgctgcaggtacacgttccgtgccttcttctgggcgctataggaagggtgcactcagcaaactccccatcccctcaatcttcaggggccctcctggcaggacgactgtgcaagttccaggtccttggaaaaccggagagattagagcggtgaattgtagtgttggacacctgcgcgttgggatattctagagcacgaaggacagccgaatggccttcgcccgccctgcccc

SEQ ID NO: 54775 - DNA, 195 bp, Homo sapiens
tggtttctagctcggggccacacaggggcctgagctcttgctgcctttgcagaccaccagcatgcaccccaaaaacggggactgggaggctcccctcagctactagggcagaagcgctatgtacagctctccctgtagcctcctgcacaggtaggatgtccacttgctccatcctggccgtttctgacgagtgct

SEQ ID NO: 54776 - DNA, 600 bp, Homo sapiens
gatgcagtatttaagctctcaactgtttgtatttggcacattatgtttttacctaatactttaacttgctttctcacatcgtggctgccccaccccaacccccccggcagaaatgattgtcccttttatggatgaggagatggaggcccaggaagtaatctgccaacagccctaccaagcccaggcagccggctggacctccgtgtctgcatgtgaggtcagagatggtcccactgactccgtcctgctggggccactggggacatctgatagggagggatccgtccacagctctgcccagagtgacctctgacatggttcagtctgcaaagctccagcatgggcagccataaagctgagagagtgcagattccagggaagattgagccgtttatcgcaggaaagcctccatcattgttgtcaacctaaacctctggcaccgtgcgtgacccgcagctccagattctgatctgagcctctaggctccgggatggagaaaggggacccgatcctcccaggcagaggcgagaggagaccagcggtgagcacttggtgtctctgccactcgcctcttggtttgtttttgatttttctattaaa

SEQ ID NO: 54777 - DNA, 3345 bp, Homo sapiens
atggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctgtgcatcgacctgggctggaagcccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctagagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctga

SEQ ID NO: 54778 - DNA, 219 bp, Homo sapiens
gagagaagaggtaaagcaaattcaagtctaagtagaattccatgctagacaggccaccaaagaggcccacatcaataatccatatttaggcggtgatgtctgtgcattatttcttaagccctctaggaaaaatgattccacagcagtgaggaaatggagccagaatgacagctgcctcccatcggagccaaggttttggtggggtccacacagatgggt

SEQ ID NO: 54779 - DNA, 678 bp, Homo sapiens
cagaatgccaattacatgttttttactcctgaggagtaactttggttactttatattcattagaaaaaatacagtggaaaatttaactttagcaatgaaaatgcttaacatggtcaaatttttgttcactgatcttttttattgaatgggtaaagccaatgtttacactgcatatgataaatgttttgctttctttgatcaaatttacattcaaagagctattataagaaacattctataaaaattccaatatgttgttaaagtagattttgattgttatttatatcacatgtaggtctgttgcttaatctttgtcacgtaaattataaacatattttctgggtattgcttgtcttaaacagtcttgaaaatgtatctggctgaataattgcctgtcacaatatttaaatgcaagactaagtattcctctgcctgcgcaccccacccccatttaatgggataatagaacataaatgtcatttgtgcatttagttgattaaatgtcactcgtttatgattgtacaactggtctatacaatgtaatggtctctgtagtaaagtaacaatacatttttagtggcattatcagtgttggtaaaataaactcaccgttatattaactaaactgtgcaaacagatttacttgtcatgtatatgttcagataactgcataaaaat

SEQ ID NO: 54780 - DNA, 467 bp, Homo sapiens
tcactcagctctccttgggtacttttgggaccatagacgaaaaggaagctaataaatttgaacaggcagcaaacctctgatgttcatcacattggcacccagcccttgagtaactaaggtaaccaggcacgagactgaattctgagccccaggtagagaaataaaactagagacttcctatcaggatggagctaatattagaatatgattcccgattaacatcacttgcattttatctacttttgaaagccctaaaatctgtttgcttctgttatgtctagatgggcaagttcacaccagataattcattctacagcatatctacaggattaaaaaaacagctctaaagcttaaatttctattttttattcagttattaggagaaaaaagttgattaaaatgtcaaggtcttttaagtaactattaatttttgaatttcaatcatttttatttacctctgcagagaa

SEQ ID NO: 54781 - DNA, 376 bp, Homo sapiens
agcatagggacgacaggagccaggacccgtgtaggagatggttctcgccatgctgggggctctgcacccccgggctgggctcagcctcttcctccacctcatcctggcagtggcactgcttcgctcccagcctctgaggtctcagcggtctgttcctgaggcattttccgcccccctggaactctcgcagccactttccggcctggtggatgactatggcatcctccccaagcacccaaggccgcgagggcctcgacccctcctgtctagggcccagcagcgcaagcgggacgggcccgaccttgccgagtattactatgatgcacacctatgacccaaggccctcataaagataccatgtgtgacaaaaaaaaaa

SEQ ID NO: 54782 - DNA, 330 bp, Homo sapiens
ttcctttctctgacagaccacttatggcccaaagagtaagtgccagcctggtcttcaagctctcagaccactggctttgcattctaggtcattctgctggacttacagagagctgaggccatggtgatggaggcagcagggcactgggtgctggccagtggctcttcggcccataacatttcttgggaaagccagcttgaattcatagaatgcaactacccctcccagccgaagtccttcaagttcaagactcccatcctctgggcagcctcctgacagtcagccctgtccatcttcctccatctgaaccccaaagcccagtctgcctgt

SEQ ID NO: 54783 - DNA, 3181 bp, Homo sapiens
ttgagtttgaggtaacaaacctgcaaattctttttcatttccaaagccttccctcaggacaaagtccaaaatgtcttatttagacctagttttaaataggaggaataatggcaagcacagttcccatctcatcacctgatgggagcacactgggctttcatgaaggactcagcataaggaccagaaaggaccatgatcaggccaaccttttccccttaaagatgaggcttgagaggacaggacagtggcttgagtcccctgcagatttaaggtcctggtcccctctgccgcaccagctgactcacaacctactgctggattcatcaggaggacaaggacctggcatcagttagggtgagtgggacagatgcttgcatttgcgttaccctttggggacctaaagggtgattttgttatggctgtcacagccttgggccttgtctcatcttttgactacggaagtacacaccagtggctctgtgcccacctgacaggtgaataaacctctgcagtaagtgtgggggcatccccaggaccccccagtgcatcagttggagaacaggagcagatataaggggacctgactcccagcccgaggcccctttgtcttgccatgtgattccagtttctccatggtaaatgggcttgggtttaacctattaaacctatttaagccctgctagaaagcataacaggagctaactaatatgagtattttcacccaagagtctcccagtccaagcattacacataattcagaggcaaagcctggggctggtggctggaagtgctatcctggttagagtgtctttgatgatactcattgttcattgaagatgagtgtgggaaaggtaccccaggattaaaattgtttcagatgtattaatattcctgttctccttgtagaccactgttgaaaaaacacacaagtcgtttttaaaaccacagtggacactcactgccttacccagatcattcctcctggggatctctttcttgtcaccagctgctgaccccagcaagttgggagacaaatctggagcagcataactcactaaagctgggtgtctaaggctccagctggaaaaagtctcttagctaccgctgcccatggcatttggagtttttaaatacgatacagaacataatctattctgccccaccccaacacacacctcataactactcttccgttccccacctgacaggaggatgacctggccttcgacagttgctcaaagccaactccccctgcactgcctgactgggtgcagaggacactcactccaccctcctagcagtccttcgatgactggcccaggcctctctgtagcagctactggcgagcatttccccaggccgtagccagggccatgcgtccgccttcctcctgctggtgcccaccctatgtgtgccccaccccctttccccagaggctgagttgggagcatgttaggaacactagctagttgctcctgaacacagccctatgaaatagggagtctgcagctccaaggtaaggtggttaagccaccctccctccagggcccaggtgtgtgaggagaggctggggacactcacaatgacctccatgatgggccagccaccacccctttctgatgcccactctgggtgctgggtgagaagctgatcctctcagggggagccccacacagaggaagccgtggcagagttgatatatggtttcactccctagcccccaggtgggactggctggtcttggtcccagggattcttcataggactagtgagcaccccacagggccatatcacaggcatcctctctccttacttctgctttcccttcccctgttaggttcgaacgatacaggtctggccgatccgttcaaaatgccagtaatggagtaagtattccttcagaatcctgtcatctcctgaggccagacctacccctccacgttttggaggctggagagacctccagtttttctaactggttttgaaatatttgggaaattgaagaggcaagctctggttgatgggatactagggcagagctagcaggcacccctgatgggaaggtggcaagcaagccctaagtttgcatctcccaggacagtcactgttgactcagcaacccctccttctagtggggacggggaggaggcagtgagcagggctcactgacatccaggcccaccatggacctggaaggcaggtgggggaagtggccttgcttctgtactagagcagcgctgatacttttcttcttggaaccctgcatagttgccttgccagcttctacctcagagcctgactccagggttctggggcttatggccaatctcatgttctgacaggtactgaatgaagtaaccgaagacaacttaatagacctggggccagggtctccagccgtggtgagcccaatggtggggaacacagcgcccccatcttccctctcctcccagcttgcaggcttaggtgagtgtctcacagggacaaaagggcctacctacttcctaccactggcctcccttgcaggccacctctctttctttcttggaagacccaaagagagtcttttgggaaatacatgtgaaagtgtattcctgagtcctagccagttgtaccaccttaccttcaattcataccttttttccccctaaatttgaagtttaaaatctatgttggaaagcagggatgggggaaattccaatgaattaaagaaaggtcacggccgtgcgcagtggctcacgcccgtaatcccagcactatgggaggccgaggtgggtggatcacctgaggtcaggagtttgagaccagcctgaccaacatggcgaaacccagtctctactaaaaatacaaaaattagcaggcgtggtggtgggcggctgtagtcccagctacttgggagactgaggcaggagaatggcgtgaacccgggaggcggagcttgcagtgagccgacatcgctctactacactccagcctgggtgacagagcgagactctgtctcaaaaaaaaaaaaaaaatcaaattggattctgctacctctcttcttaaaaaaggtatagtaggccaggcatagtggctcacgcctgtaatcccagcactctgggaagccaaggcaggcggattgcttgagtccaggagttcaagaccagcctgggcaacatagcaaaacctcatctctact

SEQ ID NO: 54784 - DNA, 1433 bp, Homo sapiens
ggcagcgggaggacagcgcgctcggcggcgggagagcgggacggcccagccgcggcgccttcagctcatcggttgcccgcaggcgccggccgagtccttcctgccgggcaggaagccctgcctcgtggggggcaaggtcgagccgttggcgcgccgggatccggctcgagccaactgaggaccgggcacccgcaggacgtgtcaggaggtgtcgaaggcccgctgtggggcggccacgcgcgttcccgtccgttccccgcggcgtcccgcgcttgtcccgggtcccgctcggctcacgggaccctccaggcccccggggctgtggcagcacgcgggtcccgagcgtgggcttccttggggccgagagcttggagcgccccaggcggccccccgcctccctgcaggacgccgccctcgcgtctccgctgcagagaagcccttgctgcccgcctctcgcgggctctgggctctttctcaccagggaccgagctctcattcgttcagccttccccgggcaagatgcacctcctgtccaagtctctcgcccttccgcctgccgcagaccgaaggtcacgcatctccagctggaatgctgcaaaagtgacgcttttcatcatgggtgcaaagtgtacagcgtgcaatgtggacttgttccctcttacaacgagtagaagaccctctctggggagaaaagaaaggtctgaagaaccgattcccatgagagaaccctaagaagacagcaacagagggccagacgcgcccctggaactggaccctggactggggcgggagggccacagccttgggagcccaggtccctgcccgcgcctccgacagtcccgcgccgccgccacccggcatctgcctctgggcctccacatctcgtgcctggaaccgcgttcattgcgcactgcaccagtaaacacctgaacactcccaccacatgctgcacgtttatttgtaacaaattagaagctgttgtaaaagataaaaattaaaacacttagactgggtgggcgagaggctcatgaatgtaatcccagcactttgggaggccaaggcaggaggattgtttgagtccaggagtttcagaccagcctgagcaacatagttagaaccgtgtcgactaaaaattttttttaaaaattagccgggcgtggtggccggcgcctgtggtaccagctactcgggaggctgaggcggggggaccacttgagctcgggaggcggaggctgcagtgagccgagattggcactgcactccagcctgggtgacagagattctgtcgcaaaacaaaaacaacaacaacaacacacaccacacacacacacatctaaaagagatgatgtagaagtacaagtaaccgtttccctctgcatcccagtggaacgtcgtgggtcttctgaagaccctctcttgccctgcaggctccg

SEQ ID NO: 54785 - DNA, 829 bp, Homo sapiens
tttaattaccccagtttattggagaacattgagaatggccatcccacagaaaactatatagaccaatttcttaccctgttatctgtgtgccacactgttatccctggaaatattataatctaccaggcttcctccccggatgaagcagctttagtgaaaggagcaaaaaaacttggctttgtttccctacaggaacaccatactctgtcaccgtagaagccatgggtgaaaaaatcacttttgaaattcttaatgtcctggagttctctagtaatagaaaaaggaggctgggcacggtggctcacgcctgtaatcccagcactttgggaggctgaggtgggtggatcacgaggtcaggagttcgagaccatcctggctaacatggtgaaaccccccatctctactaaaaatacaaaaaattagccgggtctggtgtcacacacctgtagtcccagctactcaggaggctgaggcaggagaatcacttgaaccagggaggcggaggttgcagtgagccgggattgcgccactgcactccagcctgggcaacagagactctgtctcaaacaaacaaacaaaaaaaaagaaagagagaaagaaaaaggatgtccgtaattgtccgaactcctatgggacagctccagctgtattgcagaggggctgatgaagagaataattccccaatcacccaagttgcccttcaacaatgtcttcatcaacagctttcttgatctaaatgtcccacgtgggtatgcattttctcaaacagaagcatccgtggtcacgcaggaagaactagtccgttcttatgacactactaaaaataaac

SEQ ID NO: 54786 - DNA, 328 bp, Homo sapiens
gttcaaagtgatttgcctaattcatttaaagcatatttagttttttttaaattgagtgtattttatctagatatttttaaaaggcagcatctaaccttggattttataaatacatctaaatttgttatttccagaatgcttcaaaacagatctctgtagcctcgtgctttgttattgttaggttttttttttttgttttgagacagggtcttgctctatctggagtgcagtggcacagtcatagctcactgtaccctcaaactcctaaactcaagtaatcctcccatctcagcctcctgagtagttgggaccacagtcatgcaccagc

SEQ ID NO: 54787 - DNA, 203 bp, Homo sapiens
tggggggaagagcagtttggagagttacggggaatttcttttggacctgatagttgcagaacagtatatagaggatgacatgttcctatttttgtagataacagaattatagtctacccaaaggaaaaactaggagccatatatgtcaggtttattaactgtgtgccacactttccttatctgttaggtagtgatagcaaagg

SEQ ID NO: 54788 - DNA, 201 bp, Homo sapiens
ttaacaagcttcactaactagcctttttatgccattattgccttttcacaagttgcttcccctagagactcagagtcttttcctttgtcttgccatttctttaaaaatttactattctattcttagttgaagatgctatataagccacttctaggagaactactttatttcctgtctcccatgtatatataaaatattcat

SEQ ID NO: 54789 - DNA, 168 bp, Homo sapiens
gccttcggagcttttaaaactcattgagaacaaagtgctgatgttgggcaagggtgtttcctccttccctccgtttgctgggggctctcttagatgataatagggcaggcctgtgatgtggtggcaaagttcaagaatacatattcagattttattcccatagccaaa

SEQ ID NO: 54790 - DNA, 202 bp, Homo sapiens
gcatctaacatttaatacttctaatattgctgtgggctagaaactagagagaaaagtttaactgcatattaaatcagagctgagattcttaaaaagttttacctggtgtttaagggccttttctactctaaatctggagttgaattaaagctgttggaagccaggtttctgaatatttggcttattgcttattatggtaaaa

SEQ ID NO: 54791 - DNA, 1510 bp, Homo sapiens
agcggctttcaggccttgaatccagtgggattgagaactttctaagagtggtgcggctcttgacaacatgtgggctccaccagcagcaatcatgggggatgggcccaccaagaaggtgggcaaccaggcccccctgcagacacaggccctccagactgcctctttaagggatggcccggcgaagcgggccgtgtgggtccgccatacgagttcagagccacaagaacctactgaatcaaaggcagccaaggagaggcccaagcaggaggtgaccaaagcagtggtcgtggacctgggcactggctactgtaaatgtggctttgccggcctgccaagacccacccacaagatctcaacaacggtgggcaagccctacatggagaccgccaagactggggataatcgcaaggagacattcgtggggcaggaactcaacaacacaaacgttcatctcaagctggttaaccctctgcgacatggcatcatcgtggactgggatacagtgcaggatatctgggaatatctcttccgacaagagatgaagatcgccccggaggagcatgcggtcttggtttcagacccgccactgagcccacacaccaacagagagaaatatgctgaaatgctgtttgaagccttcaacacccctgcaatgcacatcgcctaccagtcgcgcctgtccatgtactcctatggaaggacctccggcctggtggtggaggtgggccatggcgtgtcctacgtggtccccatctacgagggttatcctttgcccagcatcaccggaaggctggactacgcgggctctgacctgacagcctacctgctgggcctgctgaacagtgcggggaacgaattcacccaggaccagatgggcatcgtggaggacatcaagaagaaatgctgctttgtggccctggatcccattgaggagaagaaagtccctctcagtgagcatacgatccgctacgtgctgccggatgggaaggagattcagctgtgccaggaacggttcctctgctcggagatgttcttcaagccatctctcatcaagtccatgcagctgggcctccacacccaaaccgtgtcctgccttaacaagtgtgacatcgccctcaaacgggacctcatggggaacatcctgctctgcgggggcagcacgatgctcagtggcttccctaaccgtctgcagaaggagctaagcagcatgtgtcccaatgacaccccgcaggtaaacgtgctgcctgaaagagacagtgccgtgtggaccggtggctccatcctggcctcacttcagggtttccaaccattgtgggtccaccgctttgagtacgaggaacacgggcctttcttcctctacagaaggtgcttctgaacggcgacgaggatggacactgcactggcagtgcctaccctcgacagggtgagcgcactcctacacacagggggtggagccggcgcttattcctgtagcattaaacacccctcatatgcccctccaaaatgtgtt

SEQ ID NO: 54792 - DNA, 783 bp, Homo sapiens
tctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttattttcctgaaaaaaaaaaaaaaaaaacaaaaaaaaaaacaacaaaaaaaacaaaaaaagaaaaaaagaaaaaaaaacaaaacaaaaagacaaagcacaaaccaaacccagatacacacagcaccccacaacatcaccacagactcccccgcgacagaccgaacaacaaaaccacgcaccgcaccagtcagcaccactac

SEQ ID NO: 54793 - DNA, 1657 bp, Homo sapiens
tctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttatttctgatttgtgtgtgtgtggtttataaattttactacgtgtaacaaaagtctgcttttccagcatgagcacactggagccctctgctcactggcacttcctgactcaaaggcactaacagtgctcatgtgccttccagacggttcaaggcagaggccactgtgctcagtgtagtctgtgatgaatagtttaagtgttcagaaattggtaaaccaacacacgggatacaataactctctgttaaccagaacaccgtcatttgaccaagccctacaagagtttaccacactagatgttctgtgaatcctcgagtcagttccattgagaggggcctgtctccagggccaggctatttacttgggaaagtatttttcttacagttcttggccacagtttttttgctgagggtttctgtctgggcctatcaggtccatacttagaccctgagcatcttcttcattcagatttgaagtggcttattaaattagcaccaaatatcagtgggactgtagaaggtaacctgaacacgtagtaccattgactctcgttgaataactttatatttccataatcctgaattgtgtagatagttttctagctctcgggtccctttattgctttttaaaatagggtttgaaacatgccacaggaaggttgctctccaaaaatacacagtgcagtgcaagaaaatgctatctcattggcctactctcctatgaattgctaaagtgcccacttcacatatgtgtataaacctttataaaccagtatttcacttttaaaaagacaaggcatctctacccattaactctgcaagccaatccacttgcaccattccgcttgaccctcctctctcctggcttgggtcaaccagccaggcacctgtgacacgagtgctgctctccaggatctccactaacatgttccaggttggagtgaggacgcgctatgtgctcacactcatgttgacatgagcaaagatgatactctgtaaacaaggcccttctgaccggactcagtgcgtgtgatggtgagtgcaatgaggacagggtggatcttttggactaaagac

SEQ ID NO: 54794 - DNA, 1102 bp, Homo sapiens
gattaaacttactaatgtagcccttcccacacttctgacatttatacagttcttcttctctataggctctctgatgtgaatggccctgtgaattcatataaaatctcttcccacatccgtcgcacttgaatgttgtttctccattgtggacccgctgatgtcttgaaagacatgaggaccacctgaagcccttcccacatacattacaattatatggtttgtctcctgtatggtccatctgatgcttacaaagatcttgcctacaagtgaagctccttccacattcttcacatttgtatagtttctcttttgtgtggtccatgcaatgactattaagtgctgatctctgaccaaagctattactacaggtatcacatctaaatgatttctcttgcatgtggaccatggaatgcctattaagatttgatctactatggaagctcttaccacatatataacatttgaatggcttctccccagtatggattctttgatgttcccgaagctgggaattgtgaatgaaggccttcccacattcctcacaaatatgaggtttttctcctgtgtgtaatttgcaatgaacatacattcctgatctacggctgaaacttttcccacactgctcacatttgaatggtttctctccagtgtggattctctgatgagtttgcagttgtgagttctgactaaatgccttactacacacatcacacttatagcgtttctctcccatgtgaactttctgatgaagacaaagagctgagctataacagaatctcttcctgtactcattacatgtatgggatatctttcctgagtgtaattgttgatgaagatcaaggatggagacatcactgaagaattttttacacttcccatgctcagaaggtgtctctcctatgtgaattatagatagtcctgcgtcaacctgggaggggacatcaccttgtgtggagaactgagagctacttatggagtcttgaggtctagttaactcacttgcagtttgttcccagatttgctggcaagaccactcttcatgtggtcctgtttctggaacagactccaactcagtttggatcttgcctcctataaggacaca

SEQ ID NO: 54795 - DNA, 381 bp, Homo sapiens
gcagtgtgtccctctgccctcctttttggctaaggccagctccttcatctactcgctggctcggggtgctgttcctacaatgctcctttctgcctctgatgatttacttctttatcacggcttattcccgaaagaaaggcagctgttgttgctctagaaacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaa

SEQ ID NO: 54796 - DNA, 306 bp, Homo sapiens
tttcactttgcttttctgcctttaagagatacatacggacaggcctagtggctcacacatgtatcccaacactttgggaggccaaggtaggaggatcacttgaggccaggagtctgagaccagcctaggcaacatagcaagaccccatcatttaaaaaaaaaaaagaaagaaaaaaaaaagaaagaaagaaaaaagaaaaattagctgggcatggtggtgcatgcctatagtcctagctactcaggaggctgaggcaggagaatcacttgagcccaggagttcaaggcctagtagtgagctatgat

SEQ ID NO: 54797 - DNA, 366 bp, Homo sapiens
gaggttggactgtggtgcaggaaagcctcaagtagaggagggttgaggcttcagtccagcacctttctcgggtcacggcctcctcctggctcccaggaccccaccataggcagaggcaggccttcctacaccctactccctgtgcctccagcctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgagggtttagtgtcgagctcaccccgatcctcccacaataaaggcttctcaatccgca

SEQ ID NO: 54798 - DNA, 870 bp, Homo sapiens
tttctcgggtcacggcctcctcctggctcccaggaccccaccataggcagaggcaggccttcctacaccctactccctgtgcctccaggctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaagggttagtgtcgagctcactccagcatcctacaacctcctggtggccttgccgcccccacaaccccgaggtttaaagccaggtacacgaggcaggggacacaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgccactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgc

SEQ ID NO: 54799 - DNA, 246 bp, Homo sapiens
ccccttactgttctcgtgacagtgagtgagccctcgtgggatctgcttgttgaaaagtgtgcagcacctcccgcttcactctctctgtctctcctgctccaccatggccagacgtgcctgcttcccccttgccttctgcatgattgtcagtttcctgagcccctccccccagccttccaagtccatcccgactcccggggccctcggacaccccgatcctcccacaataaaggcttctcaatccgc

SEQ ID NO: 54800 - DNA, 935 bp, Homo sapiens
gaggttggactgtggtgcaggaaagcctcaagtagaggagggttgaggcttcagtccagcacctttctcgggtcacggcctcctcctggctcccaggaccccaccataggcagaggcaggccttcctacaccctactccctgtgcctccagcctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgagggtttagtgtcgagctcaccccagcatcctatcaacctcctggtggccttgccgcccccacaaccccgaggtataaagccaggtacacgaggcaggggacacaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagcccatcccgactcccggggccctcggacaccccgatcctcccacaataaaggcttctcaatccgca

SEQ ID NO: 54801 - DNA, 979 bp, Homo sapiens
ccacttccggccgggaccccggaggcggaggcagcgaaggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaatcgctggaacccacaaggcagaggttgcagcgagccgagtacacaccactgcactccagcctgggcgacagagcaagactccgtctc

SEQ ID NO: 54802 - DNA, 914 bp, Homo sapiens
caaggtctgattaggttaccccgacgggtagctcactgcagcgcagccagcagcctttaactcctgggctcaggtggtctccctgcctcagcctcctaatgagccatattttaaagcctgaggtgaagttattttttgatccatttaaagtaatcaacctctctgtccttccattagtctggatcgtctaaagattgttttatttttagaggctcatccggtcagatgttagtgatgtgaaatttcaggccaggcgtgacgtcagcgtggcatttgaaacagctccatgttgcccttagtgctgtctgaccgaagcctgtctgtcctcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccgtttgcgggaagacaatgcaatcacatcctgtggtca

SEQ ID NO: 54803 - DNA, 413 bp, Homo sapiens
cacgctgtatttgtcttcactgagggtcctggtgcagctgcccacaggcctggccaaggtgctgggggaaagctcccgaaatgagaaaccagccctgtcttggggagagatgtgcctttgaggctgacatctacatgctgggtggtctgggacccacatctagaatcttcgcaatgtccatgtctctcatgcctgtgaaacgcccctgctctccccttaaaggtataacttctgcatgtttgtgttacgaaggtttgtttatcttatcaaggagttcctcatcctagttcagctttctttgaggtttcctggattaatgatctcagaggctctgcttgtagctccactgtgatcacctgatagtttgggggaggttttgtacctaacatttctaccgtcctaacaactcctgc

SEQ ID NO: 54804 - DNA, 336 bp, Homo sapiens
tcgagaggatcccgtgtcaggcactgaacgctctagccacggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcttcagtgcctgaccaggcttcagtgcctgaccaggcttcagtgcctgacc

SEQ ID NO: 54805 - DNA, 350 bp, Homo sapiens
  misc_feature (8)..(8): n is a, c, g, or t
  misc_feature (19)..(19): n is a, c, g, or t
  misc_feature (22)..(22): n is a, c, g, or t
  misc_feature (24)..(24): n is a, c, g, or t
ggcggcgncggcggcgtantangnagggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaagagagcggatctgaagctcaggtgccgattctgtcctgtgggtcagccgtcctggggccaagtgtggtgctggctgaacagcaggaactcccccgccccaagccagtgaagtcctgaccgttc

SEQ ID NO: 54806 - DNA, 2798 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54807 - DNA, 2784 bp, Homo sapiens
ggctgtactggtccggaattttttggaatgcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54808 - DNA, 3020 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggaggtgggcctggctctttcctcctgccgttttctgggccgaagcacagtgcttcctcactgccctctgggacacaggctgtgaactgtaccgtgcggatgccgtctggggagccgggctgtgcacttgcattccgatcagatcgcttaaagcgcctccgttttcggtgacgctgcttcgtatgatgcagggtccttcttacgcacaattcagtagattcaccctcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54809 - DNA, 2583 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaaggtgaggacacatggtcccaggcggggctgggactggcacatggccaccccactggggaggagaccactacatcacctccctggcttccagcatcccgggtttggtttctcttcaccaatatcctatagcaatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54810 - DNA, 1386 bp, Homo sapiens
  misc_feature (33)..(33): n is a, c, g, or t
gtgaccctgaggttacgattgcattgtcttccngatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54811 - DNA, 2727 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54812 - DNA, 1581 bp, Homo sapiens
caaggtctgattaggttaccccgacgggtagctcactgcagcgcagccagcagcctttaactcctgggctcaggtggtctccctgcctcagcctcctaatgagccatattttaaagcctgaggtgaagttattttttgatccatttaaagtaatcaacctctctgtccttccattagtctggatcgtctaaagattgttttatttttagaggctcatccggtcagatgttagtgatgtgaaatttcaggccaggcgtgacgtcagcgtggcatttgaaacagctccatgttgcccttagtgctgtctgaccgaagcctgtctgtcctcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54813 - DNA, 2143 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacaatgcaatcgtatcctctaggtacctcacatccg

SEQ ID NO: 54814 - DNA, 1170 bp, Homo sapiens
  misc_feature (392)..(392): n is a, c, g, or t
tttcagaagaaacgttttattatttttttgtcgaagaaaaaaagccatataaatattagagtataaaacttgcgtgagacacaggaagagggtggggtgggagctacgtgactatgcgaagagaagcgcttataggagaagtcagtacgggggagggggtcgccttagcgcgtggacacagcacaaaacacaacacgggccgccgcgggcagatcaaggacagacggctgcgcggagcccgccggccgctggcccacccgccatcacgtaaaagcacaccgcactacactactggctattctacaccagccgaaagagggagggggcgctacactactgtaagggcaggtctggggttctctggcagccccgctggatggccggggacccangggcagaagggggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaa

SEQ ID NO: 54815 - DNA, 1877 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgctggacgacggggatccttgaacgtaatgaccctgatacgatctgcc

SEQ ID NO: 54816 - DNA, 1776 bp, Homo sapiens
  misc_feature (20)..(20): n is a, c, g, or t
  misc_feature (23)..(23): n is a, c, g, or t
gaggcggaggcagcgaaggnggnagggggcggcgggggcggcggcggagggggcggcgggggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgctggacgacggggatccttgaacgtaatgaccctgatacgatctgcc

SEQ ID NO: 54817 - DNA, 206 bp, Homo sapiens
atcctgaggagtcaggtgaagagggaggttcccagtcaggaaggggctcagccagaatccagctgctcccagcgccgcgggacagccgagggcggctcctcacattgctgctgccttccagggtttcggggaagacgtggacggatactgcgacaccatcgtggctgtggccgaagtgatcaagctgacagacccttctctgctct

SEQ ID NO: 54818 - DNA, 299 bp, Homo sapiens
aggtgtgttgttaccccattttacaggtgaggacacatggtcccaggcggggctgggactggcacatggccaccccactggggaggagaccactacatcacctccctggcttccagcatcccgggtttggtttctcttcaccaatatcctatagcagtgagtctttcaaaaataaacagttacaagtctagatagttcgaggaaactccatcatcctttttgtatcctagtacgaggctttgtcacttcacttaagggaccatgaaccactctgtgcgtggattaatttgaagtagtgt

SEQ ID NO: 54819 - DNA, 229 bp, Homo sapiens
cacttgcattccgatcagatcgcttaaagcgcctccgttttcggtgacgctgcttcgtatgatgcagggtccttcttacgcacaattcagtagattcaccctgtaagtattaaagacatcagacaatttagtggattacaaaatagaaaccgatatgtagggacctgtcaaaaagtcaaattgagagtgcacacacacacacatcctcacatagatcagtttcgctttt

SEQ ID NO: 54820 - DNA, 330 bp, Homo sapiens
gacaagcagtaaacaaatcggatggcgagaggtgctatggaagaaagataagggcaaggatagggctggagtgttctaggcagcattataacctcccaaagggtcactgagaaaggctgtactgaggtgacagagggatacagactttaaagtgacgagaggctggcgtggtggctcacacctaaaatctcagcactttgggaggccgaggaggcaggactgcttgagaccaggagcttgagaacagtcagggtgacatagcaagatcctgtctctacaaaaaaatttaaaatgaaaaaattagcctggcttggtggcagaggtgggagg

SEQ ID NO: 54821 - DNA, 336 bp, Homo sapiens
ttggacactatctagttcccattgctggagtcagggtacagatggctaggaggtcaatcatgaaggacttggccaagggaggttccaatgctggtcctcagttaaagggaatgtttttctagtgagatgaaaacaaagcaagatctgactgttgatatggaccacagtccaagacagaggatagcagttggtattagaggaaatgctccttgtattagatctgatgagttactgcaatcaataagcacaattttagaaaagggatttgatccagcactttgggagacgaaggcaagtggattgcttgaggccaggaatttaagaccaggctaggca

SEQ ID NO: 54822 - DNA, 851 bp, Homo sapiens
gtaatcagtgtaaatgtatgggtgttttaagaaatatggaccagaaaagaaacataagcagtatttattttgtgaagtaattcattgatccaaaccaaactttttagttttagaacattaaaatatgtatatgtaagttgttgcttatacacttgtctgtgtccactagaggtaaataagaacaaagttatgtctgttaagttagctttgctccttcccttgatgactctcttcccttttctttgtttattctctttctctccttgggaagggaaaatagtttgactaccagtctactatagtcctggttctggtattaccatctatactgcttagggttctccagagatgcagaaccaacaaggtgtttatacatagatggagagtgatttatttaaggaattggcacatgcagttgtggaggcttggtaaatccaaaatctgcagagcaggctacaggctggagacccaggaaaaagttttagctctagtccaaagacagtctgctggcagaattccttcttgctcaggggaggtcagtcttgttctatgaaggcattcaactgattcgatgaggcatatccatgttaaggatagtccttatgtgttttactcaaagtccactgatttaaatgttaatctcatccaacaaaacattcacggaaacattcagaataatgtttgaccaaacatctgggcactatggtccagccaaatttacacatcaaattattcatccttggctgggcatggtgtcacgcctgtaatcccagcactttgggaggcgggcagatcatgaggtcaggagattgagaccatcctggctaacatggtgaaaccctatctctact

SEQ ID NO: 54823 - DNA, 706 bp, Homo sapiens
atggagagaaattgatagtggcgatagacagcaaagtctccaggagccagacttcctcggggtgagtcacagatctgtcactttccagctgtgtgaccttggaaaacttacttaacctctctgtgccaccgtttcttcatctgatcacgggatcataatactggctgcctcatacagttgttctgaggattcaatgaaatgtattaggtacttggagcagtgtcttccatggattaagagccacagaagggtttgacaaataagtttaaaaactaatctagtaagtttccggggggaaatgtcttgaaatttattagagacaacctttattcagtcttcctcttgttcaaaatagacttagaaaattagtcgggtgtggtggtgcacacctgtagccccagctacttgggaggctgaggcgggaggatcacttgatttcctttttgacttcttgatgcttttattaatgatgatgccaaaagatttctggagaatcagccaggcgcagtggctcacgtctgtaatcccagtactttgggaggctgaggcgggcagatcacctgagttcaggagttcagatcagcctggccaacatggcgaaaccccatctgtactaaaaatacaaaaattagctgggcatgatggcacacaccgagactgtggcactgcactccagcctgggtaacagagggagactccgtctcaa

SEQ ID NO: 54824 - DNA, 307 bp, Homo sapiens
acaaatgttagctttctctggcctagaaaaagaataggatcatcaagtcataaaacgaagtatgtgatttcagcacctccacaaaatggcttcatcaaagaagagaatcccatcacatgttacctctcctctctaggttcttcagctggggctttgccctcccctctacctatggcagaacccactgactcgtggtctttccagcacttccacttgcctccattagacacttaaccccgctgcccgctgcctcatgccagggagggccaatctccagacagtgctcctgctggctgtatgatgactg

SEQ ID NO: 54825 - DNA, 1180 bp, Homo sapiens
gttatcaaatatatcttttatagttgagtttggtgtcacacttaggccttcttcaatccatttgctttaagagtttaggtttttggtagttttatcttttcctatttaaatcttctagtggagggcagaaaactgggttttccatttggttaccagttgttgtcccaattccacttacaaaataatgtctttccttgccaatttcaaatatcatttttatcctatatgaattttttaaagtattagggtattctgacatcttactatgttacattgaccttactagacacaagaaccatagcttctttacatattatttctaaaaattttgttattacaaatgggggtctttgttcttccaacagacttggtcactaagtgttactgatttctgtttattaatgctgtaccaaatcaccttgctgaaattgctttagatagttctcttgaggttttagttgtatataaccaactacttagaaaaacaaaacctcttaaatacacccaaggagatccagtatagtattgaagtgtacaatttcagtatgttcacacaatggaacataatacatagcagtcaaaatgaactatacttaacatgtgtcaacaggggtagatcagaatattaaatgaaaaaaagcaaagggcctttgtctcctggcacccggatactgagctcagtttccgtcttcactgttccatctcctccatccactactccaggatctcataggtgactctaccacagcccctgttgtcctgtgagctgcaggcactgggaaatccacagggaggatgccagaacatctggagcctgcgaaatggtattttcttatttaaaacaggatcatcatggtagacgggaggcatggtgggaggggggcgagggataaaagattacaaatagggtgcagtgtacactgcttgggtgatgggtccaccaaaatcccacaaatcaccactaaagaacttaatcatgtaaccaaacaccacctgttccccaataagctatggaaaaataaaaataaaaaaagcaaagttacagaattgtccaaatacataccatctatgtttcacaaacactaaatacatttcattatccccctaacgaagggactaagtttcttagttcctaatgtcataaaggtttacagattgataacaaatatgtagcaaaagt

SEQ ID NO: 54826 - DNA, 482 bp, Homo sapiens
aaatattcacaaaaacatggataaaataatcacaatggtgattacttcttaaggctgggagggagaagaaaaaaacaccgaagcaaatatagcaaaagtaaaatatttgttaagtcggggtgggtgcacagctgttcattacaaaagtctaggtgctattgtgaatgtctgaaacatttaagaggcttgtagagaaatattttttcttttaatattttactgcactgaagagaaatacttttgactgaattatcttctggcattctgtaatttttaatctcaaaagaatcaatgtgggcctgacaaaaagggagatttcactgattttggcaagttcctaaaatgttttgtcttctttgcacatcttagtagcaggagttacccccatttgtctgcttcctgctactagaatgtaagctctgagtgtaagctctgagtgaaagcatttttccattatattcagttacactcctacagtctta

SEQ ID NO: 54827 - DNA, 357 bp, Homo sapiens
tccaaatacataccatctatgtttcacaaacactaaatacatttcattatccccctaacgaagggactaagtttcttagttcctaatgtcataaaggtttacagattgataacaaatatgtagcaaaagtacaaaaacatgggtaaaatattcacaaaaacatggataaaataatcacaatggtgattacttcttaaggctgggagggagggaggattacaaacgacaaagtacacaaagagagcttcaatttcggtgtattttaagaaaaaaacaccgaagcaaatatagcaaaagtaaaatatttgttaagtcggggtgggtgcacagctgttcattacaaaagtctaggtgcta

SEQ ID NO: 54828 - DNA, 208 bp, Homo sapiens
attttttgagacagggtctggctctatcacccaggctgcagtgcagtggtgggatatcaactcactgtaaactccacctccctactcattctgcttgatttaaaaaaaaaatttaatccttttgttaaatttatctgataaaattctgaatttcttctctgtgttatcttgaatttctttgagttgcctcaaaacagctattttgaat

SEQ ID NO: 54829 - DNA, 983 bp, Homo sapiens
attactatgcagacgcagccgagggcgcgctcgcgctcccgggagggcgggagcgagcggcgtgtcccgttgggtctctccgctcccggggaaatggacaggccggttggggtgggggtcggctggcaaacagtggtcgggagcattgggcgggcgcgcgcacgagggcaagcacgcgcgggagggagggacggttcctgggcaacggcccctccttggcgcgggatccgcgcagagtctgcctgggtcgcacgcgtctccgcccctcgcggtgcctcctccttcctgtcacctcggttccgccctgggtggggagaagccctgctgcaccactcgggcttcccagagcggggctggcccgcgggggaaactgaggcccgggaccccgaccggcgcctgcactgcgctggtaggagtgctgtcaccgacgtcgtagagccgccgagggtgtttctgtagggtaaacatgaagcctcggctatattccaggcattttcacttggaaacattttacataaagtatttgaaggtctagataaagaataacagagtgatccatactacatgatgaggagctgtccaaacaccatgcagatgctcctaggattcttaaactagccaaaaataattccaggcattgtcagatataggataagtacatgaagacagcattagtcgcagtagcgaagacacggaaacaacctaagtgttcaccaacagatgaatggatgaagcaaatgtagcatatatacacagtggaatactattcagcctttaaaaagaaggaaatctggctaactgcaacaacatggatgaacctggaggatattatataagtgaaataagccaggcatggaaagtttttgtagagatgaagtcttgctgtgttgcccaggctggtctccaactcctgtactcaagctagcttcctgctttggcctcccaaactgctggaattaaggtgtgcactagccacattttaa

SEQ ID NO: 54830 - DNA, 1108 bp, Homo sapiens
attactatgcagacgcagccgagggcgcgctcgcgctcccgggagggcgggagcgagcggcgtgtcccgttgggtctctccgctcccggggaaatggacaggccggttggggtgggggtcggctggcaaacagtggtcgggagcattgggcgggcgcgcgcacgagggcaagcacgcgcgggagggagggacggttcctgggcaacggcccctccttggcgcgggatccgcgcagagtctgcctgggtcgcacgcgtctccgcccctcgcggtgcctcctccttcctgtcacctcggttccgccctgggtggggagaagccctgctgcaccactcgggcttcccagagcggggctggcccgcgggggaaactgaggcccgggaccccgaccggcgcctgcactgtgcgacccgcgtagaaataggcgcccgaggggcccccagcgcaacgcgggagcccggcccagcccgggggtcctgtggtgaactagcgtctgggctctgccggcttgaagtccgctgagcgcctcgccgcgcacctctagaccccgagtccccgatctagggcctccttgtagccctaggtagcgccctctaagcttgtttctgtttttaggcgctggtaggagtgctgtcaccgacgtcgtagagccgccgagggtgtttctgtagggtaaacatgaagcctcggctatattccaggcattttcacttgggtattgtgcaggaaaaaaaactacttctgcaactaaggaatgtaaagtcttaacaacggatgatttttttccaagtacagttgtatttgattggaatcatttgcagatccaacaacaaatcttgaaatagggggaaaatacaggagctgtccaaacaccatgcagatgctcctaggattcttaaactagccaaaaataattccaggcattgtcagatataggataagtacatgaagacaggtaagtcatcccaagactataacgctggggaatagataaccctggagtacaagggggaaaacttctgtctcaggagactagagttgggactccaggaacacaggggttcattacaggagcttgaacaaagagaggagtcaagaccccatctca

SEQ ID NO: 54831 - DNA, 1152 bp, Homo sapiens
attactatgcagacgcagccgagggcgcgctcgcgctcccgggagggcgggagcgagcggcgtgtcccgttgggtctctccgctcccggggaaatggacaggccggttggggtgggggtcggctggcaaacagtggtcgggagcattgggcgggcgcgcgcacgagggcaagcacgcgcgggagggagggacggttcctgggcaacggcccctccttggcgcgggatccgcgcagagtctgcctgggtcgcacgcgtctccgcccctcgcggtgcctcctccttcctgtcacctcggttccgccctgggtggggagaagccctgctgcaccactcgggcttcccagagcggggctggcccgcgggggaaactgaggcccgggaccccgaccggcgcctgcactgtgcgacccgcgtagaaataggcgcccgaggggcccccagcgcaacgcgggagcccggcccagcccgggggtcctgtggtgaactagcgtctgggctctgccggcttgaagtccgctgagcgcctcgccgcgcacctctagaccccgagtccccgatctagggcctccttgtagccctaggtagcgccctctaagcttgtttctgtttttaggcgctggtaggagtgctgtcaccgacgtcgtagagccgccgagggtgtttctgtaggaaacattttacataaagtatttgaaggtctagataaagaataacagagtgatccatactacatgatgaggagctgtccaaacaccatgcagatgctcctaggattcttaaactagccaaaaataattccaggcattgtcagatataggataagtacatgaagacagcattagtcgcagtagcgaagacacggaaacaacctaagtgttcaccaacagatgaatggatgaagcaaatgtagcatatatacacagtggaatactattcagcctttaaaaagaaggaaatctggctaactgcaacaacatggatgaacctggaggatattatataagtgaaataagccaggcatggaaagtttttgtagagatgaagtcttgctgtgttgcccaggctggtctccaactcctgtactcaagctagcttcctgctttggcctcccaaactgctggaattaaggtgtgcactagccacattttaa

SEQ ID NO: 54832 - DNA, 634 bp, Homo sapiens
agcctggccctagggtggcggaggccacaacggagcccccagccggttggaaagaggcttcctatgctctcctttccatgccactgcggaagtgctagggaacaggaagaccagggcattgccaagtgaataataacaaccatgtgtgcggcgttcacgataccccaggctcagtgagccttttactcagggtctcatgtgatgctgaaaacaatcccatgaagtttagaagcctgtgcacacgaagagacgtggtgtttccctattgatccaaactgcatgctgacctgttcctgccagggctgcgctcctcctgctttgccctggctctcccgttctgcactccctcttctaccgggaattcctggaagcaccttttattcacagtgcctgctttgaatagatacaaatacaatttgtatcttatgtagtccattccacacaattgaaaatataatgtaataaaaatcagaaaagtaaatccaggaaagtctctaacacatattagggcctcaataaatggaccctaagagggtggggaaatggctttggtttttaactgtgcttcttttgagcttgatgctgttaacttagtacaatctatcaataaatatcgtcatcaagaaaatattaa

SEQ ID NO: 54833 - DNA, 356 bp, Homo sapiens
ggtaaatatatgtttaactttataagacactgtcaaatcctttctcagagtggctgtcctgttcagcattttcaacagcaatgtatgggagtccagttgctctgcatcttcaccagtgcttagtattgtcagtttgtttgtttgtttgtttgttttttagagacaaagtctcactctgttactcaggctgtagtgcagtggcatgatcacagctcactacagccttgacctccctggctcaagcaatcctcctacctcacctgggactgaggtgcacgccacccccaccccagtggttttttaaaattccttgtagagatggggtctcactgtgttgcttagactggtgtcagact

SEQ ID NO: 54834 - DNA, 303 bp, Homo sapiens
ataataatgacatgtatacatggtttctggtatcagctttctgttctactcctttccatcctagtttatcccttaaaagaatatattaactttgtatccattaaattattaatctattttatatcctggcactgtaagaaaatgacattttctgacctcttttttcctttggctttcaatctcaattttacatttcccaattttcatttttgaagttacatttgtgcatttgaagactgatactatttaccttttgttctctaaacaaaatgaggatgtctgccattatttattgattaagtg

SEQ ID NO: 54835 - DNA, 366 bp, Homo sapiens
gaaggaataaaagaaaaatccaaaatgaagagtattatacaagacaactagtcaatagtcttcaaagtgtcaaggtcatgaaaaattgaggaagcatcccagactgaaggggactaaagaaaagtgacaactaaatgtaatgggtgattctggattagatcctggaattgaaaaagaacattcatggaacaactgacaaatttgaataaggtctgtagatcagtaacagtattgcatcagtgttaatctcctggtttagatcatgtcctaatggaaatgtttgtactatttttgtgactcttaagaatgtgggtggaggacacggatgagacctacttgcatcgacaacaaggcgttctacggaca

SEQ ID NO: 54836 - DNA, 1599 bp, Homo sapiens
actcttgaggatccctgttctgcgcaaagactcgtgagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatg

SEQ ID NO: 54837 - DNA, 981 bp, Homo sapiens
  misc_feature (949)..(949): n is a, c, g, or t
  misc_feature (956)..(956): n is a, c, g, or t
  misc_feature (980)..(980): n is a, c, g, or t
actcttgaggatccctgttctgcgcaaagactcgtgagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctatggtctcacganttcagcntggacttaaccaggatgaactggna

SEQ ID NO: 54838 - DNA, 468 bp, Homo sapiens
gctccacactccagggatagccttggaacgccaggcagttcagagagcctgaggtctggtcttggagacctgggttccaatcccagctttgccacattccagccatgtggccttgggcccttagcctttgttcctgtaaaatgggaccactgagagcccgatctcagggttttatgaggaggaacgatgagagggctgtgctgggcttcctgaagccctgtgtggcctggaaagcactcaatagatgataactcagtgtaatgatttcttctagcagatggggaaagcgagagttaaagaggcccgatcatttcactcactcattcctcaaacgttattaagcacctgctatgcaccaggtgctttgttttgtatccattaactcagggttcagcaaactacagcctccaggccaaatctggttcacagcctgtttttataaataaagttttattggcacacagtatg

SEQ ID NO: 54839 - DNA, 419 bp, Homo sapiens
caaggtgagtatgcatggatcccacgaagtcaatgcaaaagcaatttgaaaatccctgcttttcaaataggtgtaagggtttctgtccatgacaaggctgttctacttcagtcttttaaccatgtatccacacagtcccagagatggtcactagtgtcttcctcacctttaacttcctccttggaaataattttcacatgctacgttcttgacctaccaggacaaattctatgaattcttcacgtatgtgtcctgggaaggaatagccaaaagctttgacaagaataactaagtctgggctgggtgtgatggctcatgcctgtaatcccaacactttgggaggccaaggcaggtggatcacgaggtcaggagttcgagaccatcctggccaagatggtgaaaccccatctctactaaaa

SEQ ID NO: 54840 - DNA, 168 bp, Homo sapiens
cccaatgggtgactcagactcccatggcacctgctccttctgtttctcccttcgccatatatatgagctcatgggaaacgctgtgacctcttacagaggaggaaagttcatggacttctagcttctagaactgtgatacaataaactcctgttgcttatctactcctc

SEQ ID NO: 54841 - DNA, 414 bp, Homo sapiens
gatgggaagctctactggcagtgctggaatcaaatcattactatttgcctctataggaggtttcattaggcatcttcttcattatgagtgcaatataatcaaacacttatcagtacaaggcagagagaccgggactagctgcctacacatcctcaatgagctttaggaaatgtgaaggaaacatggactgaaaatcttctggtggcaggtactctcatgtgttgtcctatctgatgctctcaacaacctctaggggtagatattgtgaccctcatcttgcagaagccttggctcaagtatatgctcagaatcacagagctggaagataaacttgggtctctctagtgccagagcccatgccctctgatctctcaagggcagagtattacctttctctttttattataatctaaa

SEQ ID NO: 54842 - DNA, 277 bp, Homo sapiens
gccccccgagactggagtgtcccatctctgcccggagcctccagagactcgcgtatctcatctccgcccagagcctcctgagactggagtgtcccatctccgcccagagcctcccaagactcggatgtacagtctccgcccggagcctcccaatactggagtgtcccatctctgcccagagcctcccaagactcgggtgtccagtctccccccggagccccccgagactggagtgtcccatctctgcccggagcctccagagactcgcgtatctcat

SEQ ID NO: 54843 - DNA, 240 bp, Homo sapiens
tttgttagtgttttctacactacactcaagttcattcagcatgtcatttcaacaacatgtgacgtgtcaacttcaaaaattaaacaaaccagaaaacacaacacttgcactacaaagaacttgttttattctcaaccttctatgctagctaaacttctctgaattttgttccccacacatcccacatctggctcaattccagcttctgttttctgtttattcatccaaaatgtattttat

SEQ ID NO: 54844 - DNA, 263 bp, Homo sapiens
aaattcttccagcggaaacagaaaatcaaataccgcatgttctcattcataagtgggagctaaatagcgggtacgcatggtcataaaggtggaaacaatagacgtcagggacttcaaaaaggggagagaggaagaggaggaggaggcaagggttgaagaatacctgttgggtcctatgttcaccatttgggtgatgagttaaatagaagtctaaaccccgcttacacaatatatccatgtaacaaacttgcacaggtacccct

SEQ ID NO: 54845 - DNA, 287 bp, Homo sapiens
gttggtggtagaagagtctgtcttagggtgtgagtaggtgggtgggtaaacagtgagaagttctacagaggaaaatggtgcaaacctggcctaggctaggcagacatgctaacaggcattgatggccactttacagagacagcctgccgtgtgtacctcacagcaaacacctgacattttccggggaatccataaataactgacttttccaatgatggcctagccagtggcccaaaggcagagagcctgcctgggcctctccgttagctgccagctgatcagcagct

SEQ ID NO: 54846 - DNA, 233 bp, Homo sapiens
ggagaggtgctatgcttcatatttatggggttaattatttgtacgctcacttgatagatgaggaaactgaggcacagagtgtaagcaacttgccgacagtcacacagctagtaagcagtagagctgggaggcaaagccagccatctgacttaaccaggttctccatggatggaaatcataactatagccatttaaagcatggaatgggtaagatcacccaaggacagtgcacc

SEQ ID NO: 54847 - DNA, 530 bp, Homo sapiens
ccaaattatataagtttcagaccctcaaaatggatctacctgtatctaaagccctagacacttcgccacccttgttacattttcaagaccacagcatgttcagtggtgagacaagtcttgttcccaccaattcccaagcagcactggcaatgatgaactcttggatctccaatccccagatggccgaatcttgcagacagagaccacagaggcaggggtccacctgggtgcgtcctcatatccagcaggaagttcacagagcagaccatgcccctacaggaccctagtggcactcacacccacacaaggaaaagaacatgcacaactatcacacaactatctttctgccatttgtgacctctactgaaatccaccttccaatccaatttatgtatttcgtgatacagagcctcagacatcacagcacgtccaagtggtaagacgcaggcaggtggactgaaactgctttctaaaaggtaatgctgcttgcaagaatgacaaaaacggccaggcgcagtaatcccagcact

SEQ ID NO: 54848 - DNA, 313 bp, Homo sapiens
  misc_feature (49)..(49): n is a, c, g, or t
  misc_feature (272)..(272): n is a, c, g, or t
cgagtagctgggaggtgaagggtgaaggttgcagcgagccaagattgtnccactgcactccagcctaggtgacagagggagactcagtcaaaaaaaaaaaaaaaaacaagcccccgtgctttgaggagatgatcatagcctgctcctggggaactatgctagtggctggatagcaagcactgacctagaggttgctcctaggaataaaaaattaagattatccatagaagacaaagaaaaaaatacttcgctaatagtgggccatacatgangatgagaaagggaacttcaaattcaaactgtgatagaaatt

SEQ ID NO: 54849 - DNA, 289 bp, Homo sapiens
gtcccctgccctcaaacaccacattcctgtttggctctgtacctttgcttgggtggtttctctacttgaaatgcccttcttccttttctctgcatcatgagtttctcatcattcttcaggaactcacacaagtcactgtgtctgtgatgcctttggcaactgggctcttcattccttcttatcaggctataacatgacctgtattttaactacttatccagtaccacaccctttcaaagttgatttagtggcaacttacaaacatacataaagcagtaaaaaaagaatt

SEQ ID NO: 54850 - DNA, 325 bp, Homo sapiens
tattttttgtatagacagggtcttgttatgttgccccgactggtctcgaacccctagtctcaagccatccccctgccttggccttccattcctctactttataccacggttattcaccaagcttgtctttgttcagtgtacttcctcatggaaaaactgaggtgatatttaccctggtttttctaccagtgtgtaactgtcgctagtaccagctcaaaaaataagaaatgaataaatgagtgatgactatcactatgttgctcaggctggacttgaacccctgggttccagtgatcctcccacctcagcctcccaagtagctggg

SEQ ID NO: 54851 - DNA, 294 bp, Homo sapiens
caaaatcattccaatattgaaaaaaaaaggttcagctaactccattcccctgatatattcagttctcagtgccccttggcttcccaatttaagtcaatgtaatcacaatgcacacaaggctcttccactcagaatcttcttgactggagaatggaaatcattggagaggggctgccctaaaggtttgtagacaaggttttgaagaatcgagctacaatgcttatcaatgtctgtctggaagaaagcctacgtctctttctaaagccagcctgtcaccatttctgagccatcaat

SEQ ID NO: 54852 - DNA, 791 bp, Homo sapiens
ctgttgtgtacattttatcactcaaaaaacctcagccgtgggtcgggcgcagtggctaacatgctgaaaccctgtttctactaaaaatacaaaaaattagccgggtgtggtggtgagcctgcaatcccagctactcgggaggctgaggcaggagaattgtttgaacccgggaagagaaggttgtagtgagccgaggctgcgccactgcacaccagcctgggcgacagagcaactctgtcttaaaaaacaacaacaacaaaaacaaaaaaaaccccaatactgggtgtattagcctttccctcttacccccttttctgatcccagggttaaaaagcagccagtagcggccctgcaggaatgggcatccatagaatgagaaggggcttctagaactagcctgggagcacagaaggaagctcctctcattcaaatttatccgaacaggctttgcagaagggtagtttcatgatttctgcacattccttcactctgaaatctgtgtcgtgcccctggcactgactgtgcacctggcactgtggatgtggagcaggatccgtgatcgtggagcaggatccgtgatcgtgaggtaggaggtgggactcgactccagaggcggggttcagatgccagaccgaattgaggactagctgatacagggatggggcagaagcagcgttctgcaaggcacgcccaccagtgtgccttgttagtttactgtcgccatggccacacccggagttactgcctctttccatggccgtgacctgacaacccaaaagccaccacccttt

SEQ ID NO: 54853 - DNA, 5538 bp, Homo sapiens
ttgtttattctgttcactgctgtatatctgcagccctgggcacgtagtaggtgcttgataaatagttgttgacttgacttgttagcagctggtagaagcttcccctaatgtttcattctccaggctttattttgagtgaagttgaggccagaaggcctcagtatcctcttccagggatgctgggaactgtagactggatgaccgtgagcttttcagtgtgtgtgtgtgtgtgtgtgttttttttttttttttttgaagctggaagaaactgtacagaaaagaggcccattttgcagatatggagaccaaggtccagagggaccagggccttgccttctacggcacctttgatgggagaatccgtaggcttgatgttgaggtccttcggtttgtctttctgccttttcattgcaattccagggggagagggaccctctggcctcacccttggctctgacctcagtgcggtcagtaaagtctgcctttccctctaactttcacctctttctccccactgcctacgtgcctgccctctgcccactgaaagtgggagcatcagaagggagctgtgcccccaacccccatgtgagggacagatcagcaaaagcctcaaagtccgtgggccgtgtgtctcccatctcattgtggctgggcccccgggcaaggacaccgtgcctcgggagtgagtcactctctctctgtgccaggcaggagctccagggactaggggtgacccaagagtgaaggcctgatggggaggaggacccggcatgacagcccttggcttgctgggggaggagagtggaaacttttacatttgtttctcgctttcaacccagtaagtaggaatcagcctaacagatcagcaagagcctcaaaccttggctcgttctgttcaagaagacagaaaccacaaaggcaaggagagctggagttggctccataacaaagtgacccttgagcgtggaaaagcagaccagcaaccagcctcgccataaaccagtctgaaaggcgagtgggtgacctgggaaaacgcacttgtggcccagttgacaattgaagggttaaatgaccttaataagccgaagtagctgtgaatcagtgagaaactgtgactgcctcaaggggaaaaggtgcaaagaacaaaagagaaatacagtgaaaaactgtcagcttctcaaaaatcaaagagatgtaaattagaacagggggtgcagtttttcacctggagaactcgcagaggtttaaataagatcgtacattttacgaagaaggcatctgtagcacccttatgaatgctttcccttctgggtgcataatcgccctcctctaaattggatgctcttggggtgacctcacctggttctctctccccatcaccctgtatcccttgagaatatctgtagtgacagctcctgagcacctgttgtgtatcatgcattctatacatactgtctcattctgggggttccattgttccacttcgcagaggcaaaaactgaggcgcagaatgatgaaatgacttcggcgaggtaccccagtaggtaatggagctggcatctgaacctagggtaaccagcctcaagcccatgctctcctttttttgcttattttccaccactgtttggtccctggctctcccagagggacatggcactggctgggcctcaggggatcctggcttctcttgaattcagtgttaccttccagctgccgagacctgcaggaactgattccacaggacagtcctgccaaggaggcaagcgggccagagagaggcggcagcaactttctgacaggtgccggggaagtcccgatttgcaatgcttgcccgtttctactgtgtaaatacttacactatggccaaagtgagatgcttaaatgcagagtttggaaaagatgggcacagttggcttctgggagctggaaagagctggcttagccatagcttcaccactgcccaggtgggtgactttgacctggtgtcaacctctctgagactcggttttctcatctgtaaaatgggagcagtatttgctgcatagggtggttgattgtgaggattaaatgagtgaatgtgtgtctagcgcctgtactgtggtaggtgctgtctaagcgttcgttatgagtgcacttaactttcattcattcattcattcattcattcattcagctttcactaacttcttcagccctccagcatctgtctgtcaaagccaactgtccaccaggcctgtgctagaatcttccttttccctctctcccttggagtatcaatgggggaagggggatggcctcaccccttctgcagacgggcttgtctggatccttgtttgctgtgatttgagccaaggacagatgtagtttttttgtgttttttagaaatttccacttgtgtggctgcctcccttggtgtagccacagagggggtggagaaggcgcatcctctgggggtcgtggaccttccaaaagccaatcctagcaccccgtgttgtcagtttagaggcagtggcctgggaactggcagtagacttccgggatggctgtcgtggggccagtgctgtgcgggggaagcacactcgcggtgaacctggcttggctgcttctcagtggactgccttgggcaaaccactgctccgttctgagcctcggtgtatttttttagtctataaaatgtgctaacaatggcctcctggcaggtggtgggaccgctagttttgaagaagccgaggtggaaacgccagggagccccaccctacccctgtgggacattgagagtctccagactgatccccttcttcctggaggccccagcaggtccctgggaggagaaccagggatggcctgaggaaaggctctccctggcaaaaacgcggtcctgtttgaacttggttctctgttaacatgtgctgaaaggagacgccggtgctctgtctctagcgatccctggttccaggtccccattctgttcccaatccaagcctttgggtcgttagtcctccaccaaggccaccagtgatcaggacctctgtttccagagccctcctgtgtcccaggtgcgtgactgggacaagtctgagaaatgatcacagcccagaggagcctgcggacacgtgatgatgaaatgtcccatggggtcgtgaaacagaaaagggacattagagaaaaaaactgaggaactctgaatcaactgtggactttagcaataaaatgttttaatattatttcattagttgtaacaaattcaccacactaatgtcagatgtaaatagtcggaaaatgaggtgtgggtatgcgtatgggaactctaggtactaactcagcagtttttctgtaaatctgaagctattctcaaaaataaaatctgttaaagaaaaaaaagacagacgggtgcagtgactcatgcctacaatcccagcatttgggaggctcaggtgggaggattgcttgaggccaggagtttgagaccagcttgggcaacatagtgagaccctgtctctagcaaaactaaaaaattagctagatgcagtggtgtgtgcctatagttccagttactcaggaggctgaggtgagagatcttttgagcccaggaatttgaggctgcagcgagcagggatcacgtcactgcattccagcctggataatagagtgagaccctatgtcatttaggaaagagcccagcgcagtggctcacatctgtaatctcagcattttgggaggcccagatgggagcccaggagtttgagaccagtttgggcaacatagtgagatctcatctctaccaaaaaaaaaaaaaaaaagaaaaattaagaaaagaaaagaaaaaaaaggccttccaaagagttgcaggctcacaggggatcttggtacagacgagcaagcggtcccttccttggtgtgtgtaggacatggcttagtgagcacgtcgtgcaccttgcgtgtgtcccattcagcaccatggctgctcataccctgcctcgaccgtgcgcgggagccctgcttccctggctggaagcctctcccttgatgcccaggagaaatagcctcttgcactaacaagggtggatctgtgcttaaattacctcttacctggttcatcccaactctcttccagccctttcctctgcccccacccagctgccctcagccttcagcctcactggaggaagggtgtctcggaagagttgcatcatgagacccttggtggagtcgctcaccaggacggccttggccccgaccctggcaccagcccagggtgactttgatgtcgtgttctggcgcgtccttgggcccatttccctcctgtctcccgggggctcttttgcatgttcttcccaaggcttcagagaccttcagctccgcgtctgaagcagccatctctttcttggatctcaagagtggtgatttctggcaactgcctcagactccatttctcatctctgtctacaaaactagcctggagttgggctgtcgggttggcctggacatcctctgagcagcgattggcccttgccctgtttctgtgaatgaacgcggtcgctcttggaaagagcccccaccaccttgcagatgtgctggggtagggtgggggcgtgcgaggttggattacatgagactttgggttctttcctgcagtcattcctaagcggtacttctctgcatctggcctttaacagtgagtggacggggccagtgttcttggagcacctactgtgtgcttgctctgttagttctttgtttccttccctgacgggagttaggccttgccacccttatgttacagacggggagactggggctctgagaagcgacttccccagggtgcccggcccgcacatggtcgagcgggggtctcaaatcccgttgagtcttacttcaagtccaggctccttgatcgctggccctgcttgccctggtggcccacagtcccagagtcagtggcgccaaggtccctcaggctggttgtgaaatcagtttgagtgcagaatgacggcggttcacatcgagcttggtgcccaccctgctagcctgcctgggacttccccagcattagcaccagcatcagtcctgcctcccaggaaccccctccgtctcagacacacctccatgattggtccctgcctcacatcccagtttcttcaaatatcagcaagtttcacactgagagagaaatgtagataaccaataataaaatgaaatgacctctggtccctattgtcagagccataatagtgacattacaaaaatgcacctttagaccaggtgcagtagctcatgcctgtaatcccagcacttcgggaggccgaggcaggtggaacacttgagatcaggagttggagaccaggctggccaacacggtgaaaccccgtctctactaaaaatacaaacgttagccgggcgtggtggcgggcacctgtaataccaactgttcgggagggtgagtcaagagaattgcttgaacctgggaggtggaggttgcagtgagccgagatcgcgtcactgcactccagcctggacaacagagctagactccatctc

SEQ ID NO: 54854 - DNA, 310 bp, Homo sapiens
aaaattctgtttctgtcacagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctg

SEQ ID NO: 54855 - DNA, 2576 bp, Homo sapiens
ttgaaaatagcacaatacaggaatctgcagccatccagcaagctcatgtcaaactgaaggagcacctaaatcataatccatctccatcttcagtagtatttgtgcaggaagggccaccattcagcacacaccaggtggatgccaacataaaatgccagaccagttcacgtgagaatatcttgccgtcagaacagatgggattcctcatttcagaaatggggcctgctagcaagcctagtgaagacacaggtttagccactccagccagatacagagagcacagaagcaactcacaacaaggaaagtcccctgatcttcatctgctggtggacgtgggctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagagctaattttctaagtgattaaccaggaaattctcttacttcctaacccagcattctgttttaagagcaaggcatccggacttggaccatctatcacacttaacagcccctgattcttttatattaatggaagcattcttctattttcatatctttctttaattttaatgatacattatcataaatggtaaaaagattttattaatatatcacttatttaaatgtctttaaagaaagtatttaacttgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatcccttacttgcttatccagtgacagcaagaaactttctgatttaaagtctttcaattgaccaaaactttcttattggattctgtttcagttctcctattaagcactgcagaaacgaaaggaaagcctaggaatatgaaactaattaaaaaggcacttggtgatatgacatagtactatgctagccgttgtggatgtaacagttcatttcttatactgcattgtgccttcccaatgatgtcaaaccctagaaatattacagagatctacttttctggaaaagggtgagctctgtattgatctgcagtgactctgtttagatattaaagtaggttctgaaaagcgacctgtgtggtccctctgattagactagttaatgtctatgtgatgggcatttatttatctttattagcaaggtttaaaagagcaaattatcaagacacctatatcttttggccagactatataatattttgtcagagtatgtgaagaggagacccaatttccaaatgaaggaactttgctttttctctgtcatgttgaagagctaatatactgtgtagattttcccctaaatatggctttcttagctttatagatgttgagataatatcttttgaggaacacatgtcaagcaggaaccttggcatagatttggtttcagttgttttaaggcttaattaatgaaatgccttaatcagctttccaaacatttttatatatgaatacagcagaccaaggagctggatctcctgctatccttacacgccttgtatctatcaactaaagctgtcattaatgacttgggcaaaatggcaagaggtataataaagtcttcctgtgaattagccagtagggtctgacacaactagtcaactaacaaggttcctgactagtacctcagtatttcagcaccttaagcactgataaatttcaatcagtcaacaataaagtgagtgttccaactaga

SEQ ID NO: 54856 - DNA, 365 bp, Homo sapiens
gtgaggagcattggttaaaaaagaccataagttgttcattgtaatcatggggaggagggaagtaatttgcttgtatttctgctatgttatttttctacggactgtacattgtgaatacttggtgcacttactgaactgataaagataaattcatacttgtaggaccatttgatcattattcctacagagcagtgttagtgatgaggaaaagtaagatctgggaatataatttccacatatacatgaataatctgttttttgttaatttatattttataactgtagttgtactctaagattgtattttgtcaatggaagttaattttgttggaaatgtttgaatataatactgatgtctattattt

SEQ ID NO: 54857 - DNA, 365 bp, Homo sapiens
agcctgcaggtctctgcccacattcccattcccctgtcccattcaactttgccaggatccatcctggcctgggatttggaggcaaggtggagaggtgaattttatagtgaaatctttagacctccaaacagcacagatcccgcagggcacatcagagggagttgcttttgtcatgtgaggtgacgggcaccaagagatccatcatgtctaaattctccctaatagttctccttctttagggtcagcattgcctctccagactccacagcttcaatcagctcacatttggggaaggaaattatgccctcagccccttgcttctcaaggaagggagcttgcctgagaccatagagagggccaggctg

SEQ ID NO: 54858 - DNA, 396 bp, Homo sapiens
gacttagtttttacatctgtaaaatggggataataaaggcacctgcctctttgtgttaccaggattagccaggattatgatgagagttcagctcagtgcccagtgcagagtaagtgctcatccccctctgccagccccacctccaccccatgcagactcaggaagctatggctgttatgttgcctccatcccacttctgaaactgtgcccagagtacctcagtcatttcacttattgcccacaaagatgcagtaaattccatccccacaagctggccctgcctccttctgcttgctaagggtatccctgagcagcaggacacacctcagaagctgcagagtggtgtgggaattgcaaggccagggcagtgcactgcctataacttcccattcaacc

SEQ ID NO: 54859 - DNA, 936 bp, Homo sapiens
tctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaaggtgagctttcctggaggcattgataacatcttccccctcttccctgcactatgcctaacccccaccccattaaattcccttgatttcactgtgagtgccccggtgcaaaaagatgtaagactgatgaaaccgggcctttcatttgctctcattaccaaatttacagaggaatagaatcattaaaggtagggtgagtggataattttgttaatatgaatgcatacatttatacccagtaggcaatgtgaataaaattcaaggaatgtatttagatattgaatgaggtctcctgaagacattttaatgatttggcttaagcttcagaacaacactagctccttatgatgacttaagcattttgaaagaccaaattgaaattattctatagttatgctcagagcaatatgttaaatttgttccatttgtacttctatgaaaaaatagcagatggattgctgggaaatcctagttggcctggtta

SEQ ID NO: 54860 - DNA, 445 bp, Homo sapiens
cacatgagcaaataataattctcaagagaaatctcaaaatatttaggactaaatgaaaatgaaaacacaactaatcatagtttgtgggaagagtgaaaacacagtttagaggaaaatttatagcattgaatgcatctattagaaaaaataaatataaaatcaatcatctaaacttctactttaggaaactagagaaagaagagcaaatccaaagttagctgaagaaaaaagttaaacactagagcataaattaatcaaattgaaaataggacatatgtagagaaaatcaataaagctaaaagctgcttctttgcaaacaccaataatattgatcaacctctaaccaggctaactacgaaaaaagagaagaaacaaattactaatatcagaagtgaaataaggaacatcactacagatcttatagattttaaaagaatgataaagg

SEQ ID NO: 54861 - DNA, 5452 bp, Homo sapiens
  misc_feature (1)..(1): n is a, c, g, or t
  misc_feature (3)..(3): n is a, c, g, or t
  misc_feature (524)..(524): n is a, c, g, or t
  misc_feature (567)..(568): n is a, c, g, or t
  misc_feature (2758)..(2758): n is a, c, g, or t
  misc_feature (3129)..(3129): n is a, c, g, or t
  misc_feature (3586)..(3586): n is a, c, g, or t
  misc_feature (4870)..(4870): n is a, c, g, or t
  misc_feature (4872)..(4872): n is a, c, g, or t
  misc_feature (5123)..(5123): n is a, c, g, or t
ncngagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtaggncagtagaggtacagggcccatctctggagagtggtgatcatgnnaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccnaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgntgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggncccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctncnaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtcctnttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacac

SEQ ID NO: 54862 - DNA, 332 bp, Homo sapiens
agtctctctctcttttttttaatctttaaaatggagataagaatcttcactctgcctacgtctgtggtggttttgaggctcagatggaagaatgggaatgaaaccattgaaaccattgtgtagatgcaagacccatagtagagacccacccagccttcttgaaggaaaacaaaaccatattggaatagagacttgagtttggagccaggcctgggggccacttccacatagcatggacagactggagttgtcctctactaggtgtgcccatggggtcccagctgtcagtgcagctgatgggaaaagtgcagtgtaaagaatctctgaaccac

SEQ ID NO: 54863 - DNA, 381 bp, Homo sapiens
tggatggatggatggatggatggatggatggatggatggatggatggggcattagatttaagtccacccagcaatttaaaatttctcactcggtcagacacagtagctcaagcctgtaaccccagcactttggaggcccaagcgggaggactgcctgaggccaggagttcaggactagcttgggcaacatagtgagattctgtctctacaaaaactttaaaaattagccaggcatggtggcagacacctatagtcccagctacttgggaggctgaggcagaaggattccttgagcccaggagttcaaggctgcagtgagctatgatggcaccactgcactccagcctgggcaagagagaaaccttgtctctatttaaaaca

SEQ ID NO: 54864 - DNA, 1052 bp, Homo sapiens
aatggcatagtggtagaaaatcgatatggtgtgtccatcagtgaggcaacatgtggtgtatctggagtgaatgggaaggagtgatgatgggaggtgacaagaggggacgtgagaggcatgtctacagaagtaaccaagtctgtctttcatacccacagacctgacttttcacctcttctttcataaatttcttgcactgcttcttttgagtctagttctcctacagccccacaccactctctctttcaactgaactgttctcttcagccttcagatgtgccctggtttccttcaacatttttttgtttgtttgttttttgttttttgagaatcgcttgaacccaggagactgaggttgcagtgagctgagatcatgcaactgcactccagcctgggcaacacagcaagacttcatctcaagaaaaaaaaaaaagaaaaccttggagtcatcctcaattcctctctttatttcgtgccccatacaatatgccagcacaatcctatcatcttttttcaaaatgacacccagaactgaccacttctcaccaccaccaataccactgcaaagggctgagccaccagcatctctcatctggactattagagtaatttcctcactggtccctcttgtggctcccacctggctcaaggtcctctgactcctgcccagctctcctgatttggtctcttccccacccttctctgctgtctactctcactctctccatttcagtcatggtgactttcatgatacccctcacacataccaagccttgtccggcctcagggcctttgctgttactatgctttcagcttgggacactttcttctcatatcctcatggctccctctgctgtcatctcctgatctctgcttaaatgtcaacccagtggcactccctctccatccctctgcatcttcttaccctgttttcttgttctttacatcaccacccgacatatcatgttttctgggttttatttatagtatgtctccacaactagatcagaagctctgcaggggtaggggtttttgtctgtttggttcacagc

SEQ ID NO: 54865 - DNA, 148 bp, Homo sapiens
tgagattcagtctcacactgttgccctggctaaagtgcagtggtataaacatggttcattgtagtctcaaccacctaagctcaagtgatcctcctacctaagcctccagtgcatcctgggaccacacgtgctggccaccatacccagc

SEQ ID NO: 54866 - DNA, 396 bp, Homo sapiens
cccgcctcagcctcccaaactgttgggattacaagcgtgagccaccgcgcccagcctctcaaaatatctttcaaaatcattctcatgtctccatcttcatccccctcctttggttaagatctccagtctcctggcctttcttccctgcaaacttgagctgaaatgatttttctaaaacatcaacctagtcataactctcactgttttgcttaaaatcctccatatcatttccatcagggtatactttaaactcatgagctagacagaccatgcctttgcctgctttgccaactttaactcctgtcttctcccccttcttttgcttcagtatttctcaaagtatagtctttggaccatccccaaaagaattgccacttattaaaattacagatttgg

SEQ ID NO: 54867 - DNA, 356 bp, Homo sapiens
atgtgaagtgacttgcttgggccatctcgcttggcagcgtcaaggctgatatctgggcccaggcaggtgatctgccttcagcctctgtgagcacagcctatcccacaagaaggtcggctgtagaggatcctggaggctggacgggcagaatcagtcagccgttgcccatttgatggacattcacattaactccctaagtcaactcctcaacctcagtgccgtggagagcagggggcgggtgaggaggggctctgatggcctgtctctccgcccacacccaccgctccacccttgcttaggggccatttttagagttgggagtgctgccctcatagttcatccacaggcttgtaaga

SEQ ID NO: 54868 - DNA, 364 bp, Homo sapiens
ccaatgagacatttgcctttattcctgaagatttttggggacaaaaaaattttacccataaaaactcagaatttctccagaaaaagcctcatcaaccatctcttctcccaggaacctcctctcagcctctagtcatcagatatctcttcttttccatcctacctcttatgatttttgcacattgatttttatcctgagactttgctgaagttgtttatcagcttaaggagatttggggctgagatgatggggttttctaaatatacaatcatgtcatctgcaaacagggacaatttgacttcctcttttcctaattgaataccctttatttttttctctagcctgattgccctggccagaactt

SEQ ID NO: 54869 - DNA, 205 bp, Homo sapiens
acagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctt

SEQ ID NO: 54870 - DNA, 278 bp, Homo sapiens
ccctggcaggtgtgggtgtggttcccctgggctggagctggcagggtcaccgtagggagaggggctaagctcaggggagagaggtgggagggagagaggaaggactctgcgtgtccagtgtagaggccctgctcaccctccctggtcctgaccccggctccagccccatcagactctgcagttggactgttgctcagggcccggtcttgccccggctaggccactgtataggaggccttgtgtgctgaggctcctggtctcgcctggcgccagcctga

SEQ ID NO: 54871 - DNA, 393 bp, Homo sapiens
actgtgtagcaaatcctataataacttgttacatcaattatgtgatttttcatttataacactgactttcgaacacaaaaatgtaaagaaattcaacattatttcatcacatttttcaaaagttattgctaaaatatttacctgtgaacacaaatatttgagggataatcttattttaagagcatggttttaaaattagatacaaagtttaaaactgttttctaattgctcccaacttttcccacacatacgttttttaaatcaaaattattttggtataaaatattgagttcaggcctggcaccatggcccacgcctaaaattccagtgctttgggaggccaaggtgggagaattgcataagggcaagagtttgagaccagcttgggcaaaa

SEQ ID NO: 54872 - DNA, 2452 bp, Homo sapiens
  misc_feature (1898)..(1898): n is a, c, g, or t
ggtttctatcaaagtgttcataaaacctggagctgcagctggcccccattaggtagtttcttggtgaacgttttccaaggaaaacttttttttaacaacttcataaagccaagcacaaaaggacattgcaatgactggctgaaagacatgggactttttgtcttcgacgactaaaacgttaaatgggggcttactttgtgcatttatggaagaaaacttggaaggcattaaaggctacattttgagccttgcatgatttcattcatttatgcatgaattcatttgttcaacatttatttagtacctactatatgccaggcactgtgccaaatgttgggaggaagaaaaaggtgaataacactggcgagaacacaagtaactatttcaaagtagtctatggcaagggcttcagtgacagaatttgtaaagctacctggaaaagtgcttggtgccaataaatgctcagaatatgtgtgctcgttccttctacatacaaaattaaatgcaaatgcttagagtacaatcatgcatttattgctaaaagatgactatcaacctcacacaaaaggtattgtttggggtccaatttggaaatatgtgctattgttttaaaaggtacattttcttctaaacaacaggatatgtatgttagttttggcgcaacaccattacacctttcctatatgcttgcatacttcctctgctctcaggagaattatactccagctgacgaaatcatgcttatattttcttatgaataaaacatgaaggaggctttcccctccagcagactctcttgcccacagactcaggttggttctagatcagtgtaaacattggccattcatccaaccaacccttccattcaaccagcataggtaataataatgctgtaagagttcagaggcacaaatgatctcctgggagatgaggtggtcaggcaaggctctatgaagcaggcaatcctgaagctaggtctcaagaatgaaggttgtacacagtacaaagggagaagaaagaaattcaagagacggggaaagcttgagcaaagatgcagaagtaggaacgtgcttagcatgattgggaacaatgaatacaccagtttgacctgaacaccattcagaggattactggaaaatcaaattcacgctaggtagggccagatcatggaaaacctcaaatttcagtctcaggcattgtataaaatttgtagcctatatatggttgcacacattatacttttaaaaagtatatagcaagaactgagtccacagattctcaagtattttattcttagcagtattatttattacagtgagtctcagaaccttccaaatgcttccaatactataaaatccacaggacttggaggcctgtaaaagaaaaggtcctgaaaacatatggcaacactgtacctgggaaatgtgtccttgagaaaagaaactagtatttgcagacattgtgcaagacccttgtacatgtgttcttcaatttaattttcacataaagtctatgaggtaggtcctaatatagcccccgttttacagatgaaaaaactgagcctcagatagcagatcaatacaggattcaaactgtggcccattttgttctaaatccactattctttttaccataccacactgccccctgaatggaatttctctgcaaaaatttgagtcagggtaccctgtgattcatccataccttcagttgctctttatctggaacctagtaaaaatttctatttgcctatcatccaaacatctttgaatgtcagatattttgaggttctagccaagttagggaaaacaatgaactcaaggactcccaggacaattcattataaagtcaaactagcccttcactatatagtcaaactacccccacatttacttaancttcaagggactctacagcaagaatcagagaaaatggtgctaactggaactatttgagtggttcaggttgggggccacagccaataaggattggctctattattctggtaggctctgctgcctctttaagtaccacatgactaaaacgactgcaaacaattatactagcaggttacctttgtacagcactctatagtttacaaagtttatatacaacccccctctgaaacaccaccatttccaatttcacaaataagaaaactaaagatcagagaaagcaagtaacttgctcaaggacacttatctcaataattggtaaagtacaaatttaaaccccagctctttcacctcaaagttcaatatactactttttaagtgtgaagacactgatattgccttcattttggcaaaacaaccatgtagtgaaatactagaagtcatcaacttaactgattttatttctcactgctaatcttccaggttctgaagtgtattaggccatttttgcattgctataaaaaaatctgaagctgggtaatttataaagaaaaaaa

SEQ ID NO: 54873 - DNA, 1719 bp, Homo sapiens
aactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacaga

SEQ ID NO: 54874 - DNA, 2959 bp, Homo sapiens
aactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatcaaaaaaacc

SEQ ID NO: 54875 - DNA, 405 bp, Homo sapiens
ttgtaaggaggacttgtcaccccaagacctgtgtgcagcccttctcaacactgtgcaaaaacagaaaaacctgatctgtaaagagaccaggggcttttatcttcttgcttttcattctttctcagatctggctgcactgcctgcatgtgagttttgtcagatatcctccaaacatttctctttgttttttgttttgttttgtgtttgtttttttttgtgtgtgtgtgtgacgtgatctctgctcactgcaagctccgcctcccgggttcatgccattctcgtgcctcagcctcccaagtagctggaactacaggcgcccgccacgatgcccggctaattttttgtatttttagtagagacagggtttcaccatgttagccaggatggtctcgatctcctgaccgc

SEQ ID NO: 54876 - DNA, 709 bp, Homo sapiens
gaaaatcttggcatagatatggaataaatattaatgtctccaaaatcttctcaaaatttatactatggcacaaacaagttaaatgtaggtctcttcctcaccatctatcttaggtctctttctcatattttcctccaatctctactgctgggaaggcgagggacatggaggggagagatcacctcaagtaggcacaggcttgaaagtccaagatcaaggtagcagcatctggtgaggactgcaatcgacttccaagatgacgccttgaatgccatacccaccagaaggctggtacactgtgtcctcacatggcagaaggcagaagggaacagagagacagatgccttccatcaagccctttgattacagcatgaatgcataagtgagagtggagctttcatgaactgaatgcctccccaaaggccccaccttccaacactgttgcagtgggattaggtttctaacatatgaattttgggagacacattcagaccatagcagcaaagctgtagactaattgaagaattagtctgtaggcaaataagtacaataagatgttctgagagaaggttgtgtatgacactgcaatgtaggaaatgtgttgaatttgtgcttgttgagtaaaaaagtaaattgtatttgctaaatattttgtcttcattatcaactgatctgtataaacaataaaagtattctattatcttcattg

SEQ ID NO: 54877 - DNA, 511 bp, Homo sapiens
ggagtgtaaattgcaccatatttcatggcttttgtgcctgccagtcattggcattggctgaggggcaggtctctggagaagggggcagccatctgctgttagccactgcccagcacagcggggagtgcgtgcatgggtctgcagagggaatctggacagaggcccaatagtggccattacctcacctgtccagatgcaggcagcatgaagctaccacagcacccccacatggggtgtgtacctataaaactcacccgtagaaccgcagagctgagtgcaagctctctgtaaccagtcttgctgccagggggtgaaggagaggaatgaccgtgttcatcatcagttaaagcacttgtgttgtctggggaaggagtatgacagttaatggatctagagcggagactcagtgttccccttctgacaagaaaagtacattcacgtgttttgtaaaaagcgtatttattaaagttcaagaacacataacctgcccattttaatggaatgatagaga

SEQ ID NO: 54878 - DNA, 265 bp, Homo sapiens
ataactgaaaaatggaagaaaatatttgcaaattacacatgtgaaaagcagttaatatcaaaaatatataagaaactcaaaggactatacaacaaaaaacaaataaccatgaaaaataagcaaaagatatatataaataattttcaaagaaagacatacatatagcttggcagatagatgaatatggctcaaagtcaattatcatcaaggaaaggcaaaccaaaacaactctaagatataaactcactcctgttaaaatgtttaa

SEQ ID NO: 54879 - DNA, 456 bp, Homo sapiens
acactacatgccatggctgggcagaacacttacatatgttatctcatttactcccaacaacattttgagaatggagctgttcttatccacatttcacagatgaagcaactgaggcccagagaagcagagtaattgcctgagaccaccctgatggttaaatgggagagctgggataaatggccccagtggtctgacttcagctttacagttatcctaaactgcttttcatggtgtaaatcttttttctgtgtgtgggagaagacagctactgccaagcctgtatttacttttgggtggggattgggagggaagtttccttctttttttttttttgaatcattaaagcctgtggaagtcactataccagggtctgagtagattttgttgctctgagttcaagaccctagaggccctgaagtcatacgtatatagcatttcctgctctctcccatttct

SEQ ID NO: 54880 - DNA, 6672 bp, Homo sapiens
  misc_feature (5)..(5): n is a, c, g, or t
atggnactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgcgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggtttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggacgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtgaaaaattga

SEQ ID NO: 54881 - DNA, 6603 bp, Homo sapiens
  misc_feature (16)..(18): n is a, c, g, or t
attagaaacaaatttnnntcggtgctccctgggctgctggtcttctttaccttccagctgctcacagaacagagagtttctacatacaagcagaagatgtgaaaatattgggaataaataaagtatatgcttataaacaagttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgcgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggtttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggacgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtgaaaaattga

SEQ ID NO: 54882 - DNA, 1779 bp, Homo sapiens
  misc_feature (16)..(18): n is a, c, g, or t
  misc_feature (1644)..(1644): n is a, c, g, or t
  misc_feature (1778)..(1779): n is a, c, g, or t
attagaaacaaatttnnntcggtgctccctgggctgctggtcttctttaccttccagctgctcacagaacagagagtttctacatacaagcagaagatgtgaaaatattgggaataaataaagtatatgcttataaacaagttgtggctgctcctggttacgttgtgcctgaccgaggaactggcagcagcgggagagaagtcttatggaaagccatgtgggggccaggactgcagtgggagctgtcagtgttttcctgagaaaggagcgagacacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttangtgaaaaagagtctgtgaaatcccagggtgtggcctcacgctcaaagaaaaggccttggccttacaacacatcaccagagtggtgaatgaatgtactttgtgtgttttaggttgaaataaaatgttttatgtann

SEQ ID NO: 54883 - DNA, 1884 bp, Homo sapiens
  misc_feature (5)..(5): n is a, c, g, or t
  misc_feature (1749)..(1749): n is a, c, g, or t
  misc_feature (1883)..(1884): n is a, c, g, or t
atggnactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagacacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttangtgaaaaagagtctgtgaaatcccagggtgtggcctcacgctcaaagaaaaggccttggccttacaacacatcaccagagtggtgaatgaatgtactttgtgtgttttaggttgaaataaaatgttttatgtann

SEQ ID NO: 54884 - DNA, 377 bp, Homo sapiens
aaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaat

SEQ ID NO: 54885 - DNA, 806 bp, Homo sapiens
  misc_feature (16)..(18): n is a, c, g, or t
attagaaacaaatttnnntcggtgctccctgggctgctggtcttctttaccttccagctgctcacagaacagagagtttctacatacaagcagaagatgtgaaaatattgggaataaataaagtatatgcttataaacaagttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagct

SEQ ID NO: 54886 - DNA, 556 bp, Homo sapiens
ctttcacgctcccataaccattccttggcccacctccaagaaaaggcaggctggcctctgtttaggtgttgtctgtgcttgcattcccaacgttgacatgaggaattatcaatgggttccggacataatcagccacacggcagagtgaattccaggagtgtaaataacaagagctgcctataaatctacctcagaagacaaagggaaaagcaaaactctgcccaggaagaccttactttacaaaccagctcaaccatatttaccagccttcctgtggtcatttgtctgagctccagctagtgaagtatgagtagaacagacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactggtcttgtattaaacaactaaaatt

SEQ ID NO: 54887 - DNA, 529 bp, Homo sapiens
aatgggggagcaggtaccaggtggccagcatcctaaatgactctcagcagctgcagagaatgtaaataacaagagctgcctataaatctacctcagaagacaaagggaaaagcaaaactctgcccaggaagaccttactttacaaaccaggtgaccaaatttctaaaacatcattcccgtaatccctgatcaacagaaaggaagctctggaagcatgaatgctcaaccatatttaccagccttcctgtggtcatttgtctgagctccagctagtgaagtatgagtagaacagacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactggtcttgtattaaacaactaaaatt

SEQ ID NO: 54888 - DNA, 458 bp, Homo sapiens
aatgggggagcaggtaccaggtggccagcatcctaaatgactctcagcagctgcagagaatgtaaataacaagagctgcctataaatctacctcagaagacaaagggaaaagcaaaactctgcccaggaagaccttactttacaaaccagctcaaccatatttaccagccttcctgtggtcatttgtctgagctccagctagtgaagtatgagtagaacagacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactggtcttgtattaaacaactaaaatt

SEQ ID NO: 54889 - DNA, 627 bp, Homo sapiens
ctttcacgctcccataaccattccttggcccacctccaagaaaaggcaggctggcctctgtttaggtgttgtctgtgcttgcattcccaacgttgacatgaggaattatcaatgggttccggacataatcagccacacggcagagtgaattccaggagtgtaaataacaagagctgcctataaatctacctcagaagacaaagggaaaagcaaaactctgcccaggaagaccttactttacaaaccaggtgaccaaatttctaaaacatcattcccgtaatccctgatcaacagaaaggaagctctggaagcatgaatgctcaaccatatttaccagccttcctgtggtcatttgtctgagctccagctagtgaagtatgagtagaacagacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactggtcttgtattaaacaactaaaatt

SEQ ID NO: 54890 - DNA, 606 bp, Homo sapiens
ctttcacgctcccataaccattccttggcccacctccaagaaaaggcaggctggcctctgtttaggtgttgtctgtgcttgcattcccaacgttgacatgaggaattatcaatgggttccggacataatcagccacacggcagagtgaattccaggagtgtaaataacaagagctgcctataaatctacctcagaagacaaagggaaaagcaaaactctgcccaggaagaccttactttacaaaccaggtgaccaaatttctaaaacatcattcccgtaatccctgatcaacagaaaggaagctctggaagcatgaatggtcagtacacacatcgtccacaggactcacacaccacaaactagtcattgatccttttgacccaatttcagaaaatatgtttacatagagacacatatttttgctatttactttttgagcaaccaacaggaaaacctatccacatatgtccattatgatcctctctaatgaagactatctctttatgttgtttaaacaaaaagaaattaatgcatgagaatgtcaaagttctgagctttaagtttctgtactcaatatattgaataaaagatatatgtagtataaaa

SEQ ID NO: 54891 - DNA, 387 bp, Homo sapiens
ccctgtctctaaaaaaaattcgttttaagtgtgctcaggacataacaggagccgctggtaacatgccatttccactgtgaatatggtaaggacagaatccctgtctctaggccctcttccactagtcaatctcatcatcaccatcaaggccaacattggtattctctcctctgagacaaagtctttgacattttctatactatactatgtcttcctctccccaaatgcatatacaaataaaatttgaatgcttctttctccatttagtgtaattttttttataacatagacccaattttcaaaccccacaatggtggattttatttgatgtattgtaaaaagcgctggattgaagtcaaatggcttgggagacctaaattctactcc

SEQ ID NO: 54892 - DNA, 277 bp, Homo sapiens
aaaataaacaataataacacaattttggaaaattggatgagtgagaaaagacttagcagaactcccaaattaaagtactaaaccagcagcaggaaagccaagaagcaacttgttttacactcaagagccttcaagtgtcaggaattggcagcatcagattcttctggaagtgtggtgaagaggagagactaaaatgagaatgatgcgttgaaagtttatttaagaagcagtcagatcactagatcctttccaatcatgaaaaggtacactaccgctt

SEQ ID NO: 54893 - DNA, 780 bp, Homo sapiens
caggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacagaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctttctagctgaataaagaacaatttttaaagcaaacat

SEQ ID NO: 54894 - DNA, 562 bp, Homo sapiens
ctggacatggtgacttttggggactaatttgaattatatttttatgctctagccctctccctaggctctgaaagttcttgagaaggtcattaatgagaggcaatctacttcaaaccagagggccacctcactaaaatcaggcaaaatggcaaaattcatagcccattactcattaacttatttggagctgcccttcagtagggtaaacatttttttaagggttggggccaaattaaactcctggatcgattatacatagttccccaatacccacatggacatcactccacataattccagtgtgaaaatctcacagacttattagcatttccagatactagaactcaactagaaaacaacaaagttgtttttatgcctatcagaaaatgaagaatgttattaactttccaagaaggaaaaaagtaaaattatttataatatacaggatgtttttggcttcacatggagtctgacccaggtggtggagaaagtcacatctacgatcaaaatgaccagcctcctgaaaactgaccaatccagaataatcctttcaggttcactc

SEQ ID NO: 54895 - DNA, 235 bp, Homo sapiens
tgtatctgtttgacttctaaacccttgcttttcccactgcaaattgttttggctagagagcaggctattaagacattctagccaagccaatttcctgagagttctgcaggtaccaggtgttgctggagcccagcatctgctcagaggaaggcagagagacccagaggaacccagaatgagacactcatttttgcatcctcagtttccaagttaattttctagctcctggttagga

SEQ ID NO: 54896 - DNA, 540 bp, Homo sapiens
tggaattgctgactgcatatatagcagttacaagttatgtggagatactcctcacagtctgtaatctgggcatcaaccaagttataaaatccatttaagtatactaaaaaaatgtcttctaaagccatgattcagagtatagtccaaaggccatgagtgaaccacagaggatcttctgatgggtcatgaactgattatacatggccaagggttgcttattgaattaaaaacggtcaataaaatttggtattcctaaactaaaattagcacattccatggctttactgcagactcaccttcagtgttctatctagaggtctggcggccatgcctggcaacatccccactgcactagtgcatatgtggaggatggggatctctcaactgctttttggaaagacattctgcctattctttcattgattattctcttgagttggtcatggtttatactttctgcaattcttgcttttatttttatttattttgagacagggtctcttgctctgtcacccaggctggagtgcagtggcacgatca

SEQ ID NO: 54897 - DNA, 151 bp, Homo sapiens
attcatagccattatcttttcaaatattgctgcttcattctctctctcttcttcattaacctacgtatagtagaatttttgactatgttctgtgtgtctccaacactgtgttctgtcctttttgcccttgttttctgtgcttcagtttgga

SEQ ID NO: 54898 - DNA, 449 bp, Homo sapiens
aataggatcttgaggaactaaaatattaattaaacttgattttttgaactgttttcttagtatattctcttgggaatcgataagattatattcctcaaatcagtgccataagactaatttatttggttatgtaaagtactgaaaacttaggtatcaacattaattaggttactcaaacagatactatgtccgtattcttctaataccttgctactcaaagtatgttccaaggtctggcagcctttgtatcacctggaagcctattaggaatgcagaatctcagacgccacctcagacctgcggaatcacaatctgttttaaaaagattatttgccgggtgcagtggctcacagctgtaatcccaacactttgggaggccagggtgggcagattgcttgatgtcagaagtttgagagcagcctaggcaacatggtgaaacctcatctcta

SEQ ID NO: 54899 - DNA, 251 bp, Homo sapiens
tgctgaaaggtggggaaaaaaagtcagtctaaaattctctgcccagtgaaacattttaaaaaacagagacaaaatgacatttccagataagcaaaaatagagagaagttgtcagtatacacgcactaaagaaattttaaaagatgatcttcaggctgaaggaaaatcatactgggtaaaaacagatttacataaaggaaaaaagaaatgttaagaaatggtaaatatgtgggtctgaaatatgtagaaatt

SEQ ID NO: 54900 - DNA, 1667 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54901 - DNA, 308 bp, Homo sapiens
  misc_feature (16)..(16): n is a, c, g, or t
accaaatgtaatgcanactccattgcattcagcccgctctcccaagtcatcacaagaaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54902 - DNA, 229 bp, Homo sapiens
ggcagagctgggaggacattccaggcagagggaatcccaagtgcagtccttaaggtgaggaagccagcaggaggtggcgtctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54903 - DNA, 368 bp, Homo sapiens
actgagtttatgaacttaactggtggagcagtctctagtgatgaggggtgactggggcatggccttgagagtgggaccaaaagatctgagattctttctccccgaaaggtctgtgatggtgcctgtgttgaaaatgctttcatgttaattgtgtacacacatttcatctgtatccctgtttcttttctccctacaaaacatatgaggattttgataccaggatacttgaggtttttctattgggaaagctactgatcggatggatgctttcaggaaagcaaagaacagagcagttcaccatttgcattatatagaacgatatgaagaccatacaagtgagtgataatctatttttttttttttaattt

SEQ ID NO: 54904 - DNA, 1420 bp, Homo sapiens
tagttcttttgcctcttcctttttttgctccagcagtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54905 - DNA, 1610 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggaaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54906 - DNA, 1693 bp, Homo sapiens
  misc_feature (1680)..(1680): n is a, c, g, or t
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcaaaatgagcagacnaaggagcaccgat

SEQ ID NO: 54907 - DNA, 1588 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54908 - DNA, 906 bp, Homo sapiens
actcctgggctcaagcgatcctcccacctcagcctcctaaagtgctgagattacggatgtgaatcattacacccagcctattaatggttttgtatagcaagtcttttgtgggtggtggaaagatgaagtgctgtgaaatattgtaggagcagaaacttgaaatgtggcaaaaaccacatgggcaaaatttctgtctcttttcttatttttgcttttttgtttaaaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54909 - DNA, 816 bp, Homo sapiens
  misc_feature (10)..(10): n is a, c, g, or t
  misc_feature (72)..(72): n is a, c, g, or t
  misc_feature (77)..(77): n is a, c, g, or t
  misc_feature (140)..(140): n is a, c, g, or t
  misc_feature (142)..(142): n is a, c, g, or t
aaaacatcgnaatcccggttgttcttttgggtgggcttggtggggggaaacaggaaaaaaaaggaagcttgncaagngttttttttcttaatttggggaaaaagcttaacttgaatcgggaatgtgaatgccttttcaangnaaaagcaaaaagaaacaagaagcaagtttcaaccaatcttgcaattaataatagaaacgaataatgaaagaaccaatacaaataattccaatgaataatttcaattaaagaatttaaaaaggaacgcaatatcaaagaatgaaagaaaacaaaccacaaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54910 - DNA, 467 bp, Homo sapiens
actctagatatcccctataggcgcggtaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54911 - DNA, 922 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagaactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttca

SEQ ID NO: 54912 - DNA, 2949 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcatttgttgagcacatgttatatgccaatgtgatagaacctttacatacatatctcagttcaagactactttaaatattcatccaaagtaacaaaagtaaatgaattagggagacggggttaataatttgacccaatcagtaataatgtacacaatgataattgctgtagtaattatagctaatatatatgaactcattcatccaaagtgaatgtgattaacttcattttacagagcagttaagtaacttgactaccgtgaggaacttccaaaccgttttccacagtggaaatggaagttgtaggctactattgggaatgttaaatggtatattaattgtataccattgcaattttgacttgtatttccctgatggctgatgatgttgaacatcttttcatgtgctgatgtggccatttgtatatgttttttggagaaatgtctattcagagcctttgcccatttaaaaagttattttttattattattgagttccttatagtttctagatataagcccccctatcatacatgctttacagaagtttttacccattctgtggaatatatatatttttatttctttgcatactctttctgccccacccacatcctctttctgggacactgatgaccaaaatgttgaatcttttactattgtcccgtgagtccctgaggcgctgtttattttttttccagtctgttttctctgtgttgctcagtttaggtaatttctattgttttatcttcagaataactggttatttactctttcctttccattctgctcttgaaccatccatgcagtactttaactttgactgtcattgtatatttcagttaaaatttccatttggtttattttttatgtcttctctttatttgctgaggctatttgctgagactttttttttctttaaatggcttcaagagtgtttataattgctcactgaagcatttttatggtggctgctttaaaatctttgtcatcaggtaggtgtggtggctcacgcctataaccccagcactttgtgaaggtgaggcaggaggattgcttcagcccaggagtttgagatcagcctaggcaacaaagtgagacctcatctctacaaaaagtaaaagtaaatttaaaagttagacacacatggtggtgtatgcctgtagtcccagctacataggaggctgaagtgggaggatcatttgattgcaggaggttgaggctgcagtgagccttgttcatgccactccagcctgggtggcagagtgagaccttgtctccaaaaaa

SEQ ID NO: 54913 - DNA, 1388 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtgaatggggagtgatggcatcacagtggcggtggtgtgcagggaaaggcgtggcacgggccatgctgtggagcccatgggctcatgctgctggccggactttttccattgattaaaccttttagtggtttgggttcacaaagcttgtggtaagtccatgacttcccttagagagaaaagagagaatagattctactgtacttgccttttcctctgaggaaaaggaatattataaaaggctgaagacattattttattatgtataatagtggaaaattagggagaaaaactaaatgttcaatagggccatggttataaaaacagtgtagccatacactgtaatattctgtatccattaaagaattatgggaaattagttttaaaataatgctaagttaaaa

SEQ ID NO: 54914 - DNA, 2204 bp, Homo sapiens
ggtcctaacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagaactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcatttgttgagcacatgttatatgccaatgtgatagaacctttacatacatatctcagttcaagactactttaaatattcatccaaagtaacaaaagtaaatgaattagggagacggggttaataatttgacccaatcagtaataatgtacacaatgataattgctgtagtaattatagctaatatatatgaactcattcatccaaagtgaatgtgattaacttcattttacagagcagttaagtaacttgactaccgtgaggaacttccaaaccgttttccacagtggaaatggaagttgtaggctactattgggaatgttaaatggtatattaattgtataccattgcaattttgacttgtatttccctgatggctgatgatgttgaacatcttttcatgtgctgatgtggccatttgtatatgttttttggagaaatgtctattcagagcctttgcccatttaaaaagttattttttattattattgagttccttatagtttctagatataagcccccctatcatacatgctttacagaagtttttacccattctgtggaatatatatatttttatttctttgcatactctttctgccccacccacatcctctttctgggacactgatgaccaaaatgttgaatcttttactattgtcccgtgagtccctgaggcgctgtttattttttttccagtctgttttctctgtgttgctcagtttaggtaatttctattgttttatcttcagaataactggttatttactctttcctttccattctgctcttgaaccatccatgcagtactttaactttgactgtcattgtatatttcagttaaaatttccatttggtttattttttatgtcttctctttatttgctgaggctatttgctgagactttttttttctttaaatggcttcaagagtgtttataattgctcactgaagcatttttatggtggctgctttaaaatctttgtcatcaggtaggtgtggtggctcacgcctataaccccagcactttgtgaaggtgaggcaggaggattgcttcagcccaggagtttgagatcagcctaggcaacaaagtgagacctcatctctacaaaaagtaaaagtaaatttaaaagttagacacacatggtggtgtatgcctgtagtcccagctacataggaggctgaagtgggaggatcatttgattgcaggaggttgaggctgcagtgagccttgttcatgccactccagcctgggtggcagagtgagaccttgtctccaaaaaa

SEQ ID NO: 54915 - DNA, 326 bp, Homo sapiens
ttgagaaaactgcagaagctggaaggtcaatctctgaccttctttcctgagacaccttcatgtgacaggtgtcccactttatgcctggagggaaggaatgataacacaaagataccaagaagaatgtgaagagacctttctcagttccccccagttcaagaccattatatcgtacccacttttgtctaatcatgcttctatatgactatccattctttatcaaaactaaacatagaaatatacgattatctcaatttctgtctttgtttctgaaggctcctgtgtcacataaaacttacattaaataaatttgtatgtctctcttg

SEQ ID NO: 54916 - DNA, 606 bp, Homo sapiens
  misc_feature (577)..(578): n is a, c, g, or t
gcattctcgtggctcactacggcctcaacctcctgggctcaaatgagcctcccacttcagtgcctcctaagtagctaggactacagcatagcttggaggagactgcagcctcggactctcacctgcctcttttctgcgccgatgggagttccagaacggcggcggtggccacaggtctgatagcccagccgcagtgccaaggacgtgcagggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggttctacctgcccaccggggggctccgggctccctgcactctcacgcgcctcggccggacccnncggggcactcctcgggcgccccggcaag

SEQ ID NO: 54917 - DNA, 358 bp, Homo sapiens
gcattctcgtggctcactacggcctcaacctcctgggctcaaatgagcctcccacttcagtgcctcctaagtagctaggactacaggtgcgttccaccacacctggctaactgttaaattttttttagacatggggtctctcgctatgttgcccaggctggtcttgaactcctgagctcaaataatcctcttgcctggacttccctaagtgctgagattataggtgtgagttaccatgcccagccagccttctggtcccttgatgcatttttttcacttgtcatatctattggatgagctgctttgttttttttggagatttccttcctggaattttccatcttccttctctagtctg

SEQ ID NO: 54918 - DNA, 707 bp, Homo sapiens
  misc_feature (330)..(331): n is a, c, g, or t
cggaggcgttgaatggcccggaggcgttgaatggcccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggttctacctgcccaccggggggctccgggctccctgcactctcacgcgcctcggccggacccnncgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggcctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcggg

SEQ ID NO: 54919 - DNA, 203 bp, Homo sapiens
gttgatctgggctggtggctactgcagtcttggtcctggttctggtcccagcatagcttggaggagactgcagcctcggactctcacctgcctcttttctgcgccgatgggagttccagaacggcggcggtggccacaggtctgatagcccagccgcagtgccaaggacgtgcagggtgagccccctgtcccaccaccccagc

SEQ ID NO: 54920 - DNA, 627 bp, Homo sapiens
gcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggcctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcggg

SEQ ID NO: 54921 - DNA, 190 bp, Homo sapiens
cggaggcgttgaatggcccggaggcgttgaatggcccactgccctctgacctgtctttccgctccccaacccctagcaacctgcccatggtgcagctgtgggccgcccacgcccatgaaggtaaggaacatgccggggtcggggctgagggctgctgggctgacgtcccagccactctggccacttcatg

SEQ ID NO: 54922 - DNA, 384 bp, Homo sapiens
gaccctcctgcctcagccttccaaagtgttgggattataggtgtgagccactgcaccccaccactaattcctgctctccttatatcaatttatgacattcagggttgaagatgggcccctacccagaaacatatgcccttgagaagaggattcacagagaccctttaagagccaaaccaacaaagccgtgaaggcaatggtggaataattaacaatgaggttgatatttctgaggtgcacttgttcagcctgccctgcccccttctccatggggtaactgggccctaggcttctcctgagaaccatccctttctgataggtcctattatgaaagtcttccacaagtcttacttggatacactcgtaaagtaggctgtgactgtc

SEQ ID NO: 54923 - DNA, 162 bp, Homo sapiens
acgtcaccagtgttttcaaagaaaaggactagcaaattaagctaacaattggttaatttttcattacccaaattaaattacccatttacctacatgcgtttataggctgtatcttaaagacttgtctgaggagaaagagaagtttgctttagtggctggcaa

SEQ ID NO: 54924 - DNA, 212 bp, Homo sapiens
tggacatgcaaataacagccgattaaattaagaccctaataggtgcatgtggaaagcatttatgtgcaatgtggtgcacttcctcttggcacctttttctgtgtctttgcagagataccagttttttctgagtgactcagggtgaatactgggcactgagaatgctgtattcagagtcattactgtgaacatggttaatacatttcttccat

SEQ ID NO: 54925 - DNA, 244 bp, Homo sapiens
tccaaatacataccaaatttttggcttcccagaaatcaatttaataatttgaattttattacaatgtaggcactgtgataggtgttgggaggatctaagatgagaaagatattgtcagtgctttcgaagtgctcacagttcttaccctccattttactacctcacatggcattattaattaatgcactcagatctcttgctaaccagaatgtaatgttttgatgtgaaagattttatacatcat

SEQ ID NO: 54926 - DNA, 145 bp, Homo sapiens
agcgagattacaaaggatagtgtctattgaagggtcagggacatgaaagcaaaagagacccaacaaatggaatgaaaatggaaagtaattgataaagactgcataattttaagacttagggaaaagaagaaaagaaaagctctaa

SEQ ID NO: 54927 - DNA, 2077 bp, Homo sapiens
  misc_feature (928)..(929): n is a, c, g, or t
gtgctacagtgacagaggcaaatagttgcagcagagactataggacctccaaaatgtcaaccatttaccatctggccctttagagaagtctgctgacccttggcccagggctacagttttctcatctataaagtgaagttcaggtttttttcatctttgacatttgagactatctataagccatatatttttattataaaactgccagagagaaggtttggtttgtatatataggtgtacattgtttgtaagcttttaggcgaatgtattttatgactctgttttgtcttagctggctacggtccttgaaaatattcttcagaatgactgaattgcatcacgggatgaaagagccacggggtctcacagctgagttctcagggactttgctgatgtgcttcctttcttggtgtccttggaatgacacccagcaggtgtcccagggtggattgtggggctcagcctgtgaggatattgagagctgggtttttgtccaggccctggctggcagctgggaatgaaggcagtgatcgaaggcagaccaagcatagtctcctttccatccccagtgacttcgtaaggaggtgagagaaaagggccccggttgttacatggggtcctttagctcctgttaagaatcagacagttggccgggcgtggtggctcacgcctgtaatctcagcactttgggaggctgaggcgggcagatcacgaggtcaggagatcgagaccatcctggctaacacggtgaaaccccgtctctactaaaaatacaaaaaattagctgggcgtggtggtgcatgcctgtaatcccagctattcaggaggctgaggcgggagaatggtatgaaccagggaggcggaacttgcagtgagccaagatcatgccactgcactccagcctgggtgacagagtgagactccgtcnnaaaaaaaaaaaaagaatcagaccgttgtagggagtattttgccttcacataccagacatgagacatgagagcagccttcctcctaggcttctgagaagagggcctgcttagcccaaagagagctgacaccacaaaaagctcccctgaagtgaatccacttaaaacggggaccaaaatttcatatgtggtggacactgggggataggggaaacctgaatggaactttaatcatgaaaatggaacaaaatgacaaaagcatgttcataattttaaagatatattaattctgacaaggaaattaagttgtttttgaagtgaaactgattttgtatcttacaataattttctcatttgatttttgcaacgtgatcatagaaggaagttttgcaaaaatatttgagggcttcatcagttttcagaaggcctcttgatattttgatattcacattcttttttataagtatctatcggtgatcacctcctcaactttccttttattgttaactggtctgagtctgtcacccacacttttcagagcttttgcttaaggtttgagcagttttctagcattatttatcaacttcatcaaatccaccaccatttgcaagatttgtgattattgcaattaagttgcattctatttgtgtcatttgtcatatgcttacagtataaccatagagactaacagaagaccagaatacagtgggcaggataaatacattggcttcaggtacttaagaagcaaagagggactaactttttataaatagctcattagtgaatgttttcacattgggatgactttcacttctctatataatttggtagctgcaaggacttggttaatgaatatgcaaataataaagacccccttttatttataatgcagatatgttttaataatgtacatgccctttgaacttagcatttacacttctcagaagtcttcagcctgagcaacatagctggggactcttgactctacattagccaggtgtggtggtgcatgccttgtagtcccagctgcttgggaggctgaggtgggaggatctcttgagcccaggagttcaaggctgcagtgagtcatggttgtgccactgcattccagcctgggtgacatagtgagaccctgtctcataaaaaaaaaa

SEQ ID NO: 54928 - DNA, 4994 bp, Homo sapiens
gcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtgtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagtaata

SEQ ID NO: 54929 - DNA, 4863 bp, Homo sapiens
aaagaggagaacctccgcttaccacagccgggtagaaatgcctgaggaaagcagcggagcgtgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagtaata

SEQ ID NO: 54930 - DNA, 4242 bp, Homo sapiens
attagccgggcatgatggcgtgtgcctgtagtcctagttactcaggaaggagtctgaggtgggaggatcatttgagcccaggaagttgaggctgcagtgagccgagattgtaccactgcactccaacctgggcaacataataacaccttgtctcaaaaaaaaaaacgaagaacaaaacttagaataagttggttctcataaaggtcacatgtataaaataaagtagggacttcctgttagaatttatttgtaattcatgttggttttcttagctatgatgctaagtccagtgctatgattgtttttacctcttcttaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagtaata

SEQ ID NO: 54931 - DNA, 4934 bp, Homo sapiens
gcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagtaata

SEQ ID NO: 54932 - DNA, 4809 bp, Homo sapiens
aaagaggagaacctccgcttaccacagccgggtagaaatgcctgaggaaagcagcggagcgtgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcatttctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagtaata

SEQ ID NO: 54933 - DNA, 1454 bp, Homo sapiens
aaagaggagaacctccgcttaccacagccgggtagaaatgcctgaggaaagcagcggagcgtgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctc

SEQ ID NO: 54934 - DNA, 2237 bp, Homo sapiens
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54935 - DNA, 2183 bp, Homo sapiens
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54936 - DNA, 2396 bp, Homo sapiens
  misc_feature (114)..(114): n is a, c, g, or t
tactagtggatcccccgcgctgcacgaattctgctcgcgagagagagagagagagagagagagagagagagagagagagagagagagagagagagagagagagagagagagtanacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54937 - DNA, 2213 bp, Homo sapiens
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccatgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54938 - DNA, 2394 bp, Homo sapiens
ttttttttttcatcctactttgttttattgggcgttgattgttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54939 - DNA, 2288 bp, Homo sapiens
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54940 - DNA, 2201 bp, Homo sapiens
  misc_feature (2123)..(2123): n is a, c, g, or t
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaaaaagaaaactcgtgccgaattcggcacgaggggaaggctccctaatgacagtgagtcaagccttgcctgagagtctgagagagacactttcagagaanaacagtgtggtacacagaaagcctcttggacactcgggtaatgggccaggagcgctctctaggaggcaggctccaaca

SEQ ID NO: 54941 - DNA, 1935 bp, Homo sapiens
ttttttttttcatcctactttgttttattgggcgttgattgttacaggtcccagcctgtagacatcttttactccaatttcctgaatagatagctttattccttcaaggagagtaagacgggcagctacacccgcagcagttacctgccagctgagcaactggtcagagtggacagattgctttccgtgccaggacaagagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 54942 - DNA, 3393 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 54943 - DNA, 3183 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 54944 - DNA, 3294 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaaatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 54945 - DNA, 1633 bp, Homo sapiens
gtttgccacaatcctgggccaccgattattccttgttgattctcctgctgttttcagtttggaaattttctataattgaaaaagatgtgggttttatataaaggcagaacaaatagtgccaaaacttgatatcacaatttttatgtagttgatttcatgtgctttgggcagcattaatgttttttttgacaattacatcctctcattgtttgccctcccccatgtctctctatcctgtgattctctctctaatctccttttcaccagcaggggaagtcttcattctcttgattgtgtcctctgtgccacaagtgaagatgtttgttttgtttctctacagggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 54946 - DNA, 1529 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 54947 - DNA, 347 bp, Homo sapiens
atgcttcgctccctgcagcacaaatactctctccctcctttcacttctttctccaaacacctagagctgctcggggcggcccagatgaacccatgagtggtgatggggaacaaaggctctgaactcacatcaaaggggttcaaaccccagcacttaacaagctgcgattccttgcgcatatccctcaaggcctctgagcttttgttttttcatctctaaaacggggagggggggggaatatcttcatagggttgttgtgtggatcgaaagagatacttagcacaatgcctggcacacagcaggcactcaacaatgttaaccacaagtatacgtaaaggaaggagagg

SEQ ID NO: 54948 - DNA, 434 bp, Homo sapiens
tggtctaaatgcttagtaagtagacagagatgatatagatcttaataaatagtttaatgtgaaactagagaatgaagcaaaggtatgaaaaatacttttataataactgatgtctgattttatctttattattttatgcgtaaaagtgttacttggaataagaactggtagcatcccaacattctagcaggctccatttctctaccaaaggtaatcaccagttggtaagcaatttttttttttttagtaaactggaatttgtacatccaaatgattgctgttcttcaaagtggacatattggatgataagacattttaagaactcctatttgggaattgtctttgctgctttggctattaatgtacctgtatcttgactccctactcaccacttctctaagacttgtcccttgccatcaaggaagcttcagtaa

SEQ ID NO: 54949 - DNA, 455 bp, Homo sapiens
agccacttctgttgaaggaaagatcatggtgaacaaacaagcatcatacaacaccaggtggtgatacgtgttatgaaggtaaataaaacaatggtaaggggagttctagagcaacaggactgccattttagattgagtgtccaagaaggactctgagagtcatcattagagcagactaccgagtgacatataagaacgtcacacaagtgggagttgagcagtgagaacacatggacacagggaggggaacatcacacaccggggcctgtcagcggggtggggacaaaggggagggagagcattagggcaaatacctaatgcatgtggggcttaaaacctagacgacgggttgataggtgcagcaaaccaccatggcacatgtatacctatgtaacaaacctgcacgttcagctcatgtatcccagaacttaaagtaaaataaaaaataaaacttt

SEQ ID NO: 54950 - DNA, 351 bp, Homo sapiens
ttgcccgggctggactgcaatggcacaatctcggctcaccgcaacctcagcctcccaggttcaagcgattctcttgccttagcctcctgagtagctgggattagaggcatgcgccaccacgctcggctaattttgtatttttagaagaaacagggtttctccatgttggtcaggctggtctcgaactccagacctcaggtgacccacccaccttggcctcccaaagtgctgggattacaggcgtgagccaccgcacccggtcttctgtgttattaacagcacttttggtgatcttgaatgcattggcatataactaaaaaatttccttttggaaaaatgtcaagaaagggg

SEQ ID NO: 54951 - DNA, 445 bp, Homo sapiens
aactgtgagaaaagaacgtttctgtagttgaagccacctcgtctgtggtattttgttatggcagccccagccaacaaacacacggtggtgtatacacttcaggtaaccatgagcatatggcagagctggcagtgaagcctgagtttgtgtcctgacacattcctgtcaccgcgccttgctgcctcctaggtgcggcaacaatgctggctttcctgacggagagagggaggccggcatccccaggccacacctataatgcctctcaccccatacacgtgtgcacaacacgcctcctcccctcctcacaatcttgggtgcacccagtagctacacccggctggcaccggagcccagggaggccagccccactctaaagaggccccgaagaattcaaggcctcctaggagtaccctgaggagaagaaaataatccctcaatggggagt

SEQ ID NO: 54952 - DNA, 326 bp, Homo sapiens
ggttgtaatcctagctacttgggaggctgaggcagagaatcaccttgagcccaggagttctagaccagtctgggtaacatagtgacaccttcatctcattacaaaatgtcctctttttcaaggaaatttgatggggtctatttgcttcaagataaacctcactaaacccagatttagttgctatctgtcattttcgttgacactggttctctcatatgaaggtgtttctggggttaatgtgtttctagtgcatttccagcattttaaagctatttaagtaagacattgtcctatatatgttaataaaattcattattaaatatatt

SEQ ID NO: 54953 - DNA, 104 bp, Homo sapiens
ccattgactttatggtggtgctcgttatctttagtatttattttattaaattattattttatttttattgtagtttttctatccaaaatagaaacgcctcttca

SEQ ID NO: 54954 - DNA, 705 bp, Homo sapiens
attcctgcagttctagtgtgccgactgaaaccctggagccctgagcaggaattccttgggagagtttgctgagggcctactaggtgcatgtattaacacttctgcgatttctgcaaggatcatactgtctaaaggagaaacacgttttgtgagacaacactttcatagatgtgcagtagaagcctctggtttttccaaatgaggaaggcaggtgagagcatgggaaccacatcaaagccttgcctagaaatctgtgccgggagagggggcttctgtctgcttgaggagggcagaggagtgggagtgagaagccaggaagaaaattctgttcctctgggccaggttacagattctcatgaaagtgctgaacaccacggactcaggctcgtggttaagaaagagcctcgttttacgatctccagtcatttggtcttctgtatcaaaaacacactttcactggggatgtgtgtgtgtatgttatatacacacatgtatatttacatgtacattttctttctaaattaagcaaacaggtagaaggtatgtttctaagggtaactctccttttgtttttccctcaattctggaccagaaaaatcagattagcagggctctagtaaacgtttctgtttttcccaattccaaacttcaggtcttttcatctctaagtactccattttatataagctataactcctgtgtaaa

SEQ ID NO: 54955 - DNA, 438 bp, Homo sapiens
gaggtgggacaggttgcccccatactggctgctgctttcctggtcctctctcctgcaaagaaatgcagattccagcagtttgaataggtttgagcactctgccagcagcttttattaccaataatattgtttaagcttggaaaagagaatgaaactacccacaactgtcccacaagccatgacatggcagaagtgtttgtgtttcgtgtgctccccccagtgtgttttctgtgcatctctgcaggttcactcattcagcagctgtctactgagtggttgtcacgcaggaggttcctgtttgaggtgctggggatatagcattgtgtactcactgggagaatagtgtgggcagctagtgatgagtaggaagaaaaacaaagcttggtaaggggttcgaggtgtgattgtgactatttagacagggagattgggaagacc

SEQ ID NO: 54956 - DNA, 731 bp, Homo sapiens
cataaagctgcattaacctcatacaggcactagaataacaggatcagcttgtgcattttaagattgtagcactgtgccgatgactttgaagatgcgtttatctgtgttaaatgaaatgttatgctgccctaacagaatcggagttgatgctgcttcctgtcctgacccctgtgggtctgtgttccctgataattttacacaacactgaggcgggaagaacgtaaattccaggaatgcatttatggttaatctgttgttgaggtttagtcagacagccagtgttttataaaccaagcctcccatgaaattgggctggaggaagagggatctaatagagcagataattaccacttgctctccattaactcagcccttgtgcccgggacacttttccttttggccagcaaaattggagtggctttgtcatgtttacagggagcctgcctgttggctattagagagggacagaaagaatctgcatatagaaaccctgaaagaatacacactaggcaactaataaaaatggtcgggaacctgagcagcatagtgagaccctttctctaaaacaatttttaaaaacttagccaggcatggaggcacacactaggtcccagctactccggaggctgaagtgggaggatcccttgaacctaggagtttgaggttgcagtgagctgtgatcgcaccactacactacagcttgggcaacagagtgagacccagactcttaa

SEQ ID NO: 54957 - DNA, 470 bp, Homo sapiens
tgctccttaagatagttatctgaccagctttgttaaaactgggaatctaaggatctcttaactccattttggtttgaagaaagatattaatattgaaatacatagttgcacaccaaatggcagtggggtcaggggttggggtacacttttatatctgctctcatttttccatccctgccagatagttgttatttctgattctaattgttacttctgattctctaaatcagtggacttgtaattatatattgctttgctaattatgtttccttaacattattttgacaaagtttcagttattatttacatatggctccttttaccatcagattgccatacacaggcataaatgtcacaaatattaagatagttgaagttttcagagcggcagacatttggggaaaattatggaaccttcatgtgttggagctggaaagagcctttcagtcaggactactttaatcatttct

SEQ ID NO: 54958 - DNA, 664 bp, Homo sapiens
aggtagggaagtttggcaggattgtagataagggagattaaaatactgaccacaaaaaacaaacaggcagttttgacagaatttaataatcaacaactaaaagttcctagttgtgaagcagttgttttatctgaaagacaaatgataaaagaaagctttgaaaattatagcaagggctcataaactgagaacaccacaatgggtaagtgaactgagaaaaacgtatttattctgtacacgcaaaggctgagacatgagatacttcattaactctgaaacttctgaggatggtgccaggttttcctttttagagctaggcaggaagcatttaaaaatcacaaaaataagcctaagaagacttgccaaaggtatgttcattgaaaattaattgtgtcagctgatggagacttgaaagtctttatgctatcaagtaattatgagtacacaaaattttagatggtctagtcttcacaaaaacaaggaaatactgtcaggcaggaaaaaaaaaacaagagaaaatagtgtatgtatggcatcttttgtggggagaaggaagagaataagaaaaacattcacatttccttctatttgcataaagaaatgcaggaagaatatacaacttacaatggtgatttacttgtaaggaggaacagggagctgggtg

SEQ ID NO: 54959 - DNA, 434 bp, Homo sapiens
tgatcttgaactcttgggctcaagcaatcctctcatcttggcctcccaagtagccaaagctggctcatgtcaccaagctggctttagttctaatgaagatttaagatagtaaagtccatcagacaaaattctggtgatataataatatatcttatattctctcaactcctccctatttataatgaacaaatgtttggacaaaaaaaatgtttagttcaccaccatggagtacatactgttagttgcctatccaacatgcatacaatccctatgcccttcttaagggaactgctgatcatcctctcattgttgtgtacttcagggaaaactgaacctcagcctcaggtatagggaatgaatcctgggtagtttaagccaaccatggtaaacccatttcccatgctgactattaatttagaaacagacacgtaaca

SEQ ID NO: 54960 - DNA, 248 bp, Homo sapiens
attatttttcaagattaatatttattccagtaactgaatgtttcttttccaatgaaatattctgaaaataattcagaaaggaaatattcagtaaagaaatatgttgtctgtaaatctaaagaacatatgtgaaaattctatatgcaaaattacatgaatgagactttctggtatattattactatgagaagtactagacagtatgtttaattttaattttcaaagttcttacagattaagtattgatg

SEQ ID NO: 54961 - DNA, 397 bp, Homo sapiens
ggtttgcagaacattggctacagtaagaacatactctgcatcagagagggttcaacattaacaacgtctgtaaaaacagaatcacagctgtcaagaagagtgctttctccatgtactgtgaaacacatccatctggatccacctatttaagctacatgcctagcctccagagtcatccagacttttagcataagaactcaaatgagaaatcatgaagaatgcattaactgaatccaatatcacctacaggaccctgggcccattgcactttgtaattgtattacttttcttctggttatcttcataggatcttaggtatactctctctgaaaagtgttaaagacaacttctccctgggcctgagaataaattatctttttcctatcgctgtaaaaaa

SEQ ID NO: 54962 - DNA, 618 bp, Homo sapiens
aaaagaagacacaaacagagaagcagagagagaatttaggggcaacatgatgagtttgatcacagatttgatgcgtgggacatcagtacaggagaagatgtatataaaacttggcatggtgcagggatgtattcaagaactctacaccgccaccaccgcccttctaagtcacttttgtctgttgcctggcctgctgcagtagcctttttagtcctcctagtagttttcttgccacctccaatttactcacaaagatgccaaagtaatatttttagaagcaaccatattgtattactctcctatttaaaacccttcaaaagcaccaggcatggtggctcacacctataatcctaatacttgggaacctgaagtgggagtattgcttgaggctgggagtttaagaccagcctgggcaacatagagagactctgtcgccaaaaaatttttgtatttagccaggcatggtggcttatgcctgtagtcccagctactcagagggctgaagtgggaagattgcttgagcccaggagttaaagcctgcagtgagctgtcatcatgctattgcattccagtctgggtgacaaagtgagacaagaaagaaaggaagaaaggaaggaa

SEQ ID NO: 54963 - DNA, 1010 bp, Homo sapiens
ggctggtgaattaccagatctccgtcaagtgcagtaaccagttcaagttggaaggtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactggtgagaatttcttcggagtaagaaatcctcagaggaaattacccagtatattcaaagctacaagggatttgttgacataacggtctgttttcaaggcagtttccggaaacagtgaccctgagaaggcttcctcctgagtatgcataaacattcacagcttgcatgcgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggga

SEQ ID NO: 54964 - DNA, 505 bp, Homo sapiens
cccagtgaggacagatattttggtcaccatcaagtggatctttatttttatctaacatttacaattctgccagttcttactcttaattctctttgccttgaatcccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatgga

SEQ ID NO: 54965 - DNA, 626 bp, Homo sapiens
acattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatattatatatatgtatattatatatacagtagcttacactta

SEQ ID NO: 54966 - DNA, 2567 bp, Homo sapiens
cacaccccatctgggggaaggacaggagctggacaggccaagagctatctcccttggctggagaagaccgggaaaaagggagtactggagccaggaaggaagaagagggagggccagtgctggtaaaggagaagttgggcctgaagaagttagtcctcacccaggagcagaagaccatgttgttggattggaatgactccatccctgagagtgtgcacctcaaagctggggagcgaatttcccagaaaagtgctgagaatggtagaggaggccgtgtgctaaaaccagtccgccccctgctgctccctagggcagcaggagagcccctgccaacccagagaggggctcaggagaagatggggacccctgcggaacaagctcaaggggagcgaaacgtgcctccacccaagtccccactgcggctcatagccaatgccatccgaaggtctctagagcccctcctttccaactctgaaggcgggaagaaggcctgggccaagcaagaatccaaaactttgcccacacaggcctgcactcgctcattcagccttcggaaaaccaattccaataaagacggggaccagcattcccctgggagaaaccagtcctcagcctttagccctcctgaccctgccctccgcacccacagtttgcccaatcggccatccaaggtctttcctgcacttaggtccccaccctgcagcaagattgaagaagtccccacactcctcgagaaagtgagtttgcaagagaacttcccagatgcttctaagcctccaaagaaaagaatctcacttttttcctccctcagactcaaagacaaatcttttgagagtttcctccaagaatccagacaaagaaaggacatcagggacctctttggcagccccaagaggaaggtgctgcctgaagatagtgcgcaggccctggagaagctgctgcagcctttcaaaagcacctccctgcgccaggcagctcctcctcctcctcctcctcctcctcctcctcctcctcctcctcctccccctacagcgggaggtgcagactccaagaactttcccctcagagcacaggtaacagaggcttcctcttctgcctcttcaacctcctcctcctctgcagatgaagaatttgatccccagctttccttgcagttaaaggagaagaagacacttagaagaagaaagaagctagaaaaagcaatgaagcagttggttaagcaagaagaattgaaaagactctataaggctcaggccatccagaggcagctggaggaggtggaggagcggcagagggcttctgagatccagggtgtgaggctggagaaggcgttgcgaggagaagcagattcaggcacacaggatgaagcacagcttttgcaggaatggtttaagctggttctggagaagaataaattaatgcgatatgagtcggagctcctaatcatggcccaggaactggaattagaagatcatcaaagcagactggagcagaaactgagagagaaaatgctcaaggaggagagccagaaagatgagaaggatctaaacgaagagcaagaagtattcaccgagctgatgcaagtgattgagcaaagggacaaactcgtcgattccttagaggaacaacgcatcagagaaaaagccgaggaccagcactttgaaagcttcgtattctccagaggctgtcagctgagcaggacttgaggaggcccgtagtccctctccctggctgcacgttgggaccggatcaggccaagtgcaccacacaccctcatgggtctttctgcaggatttatcatccctggaacttaagttataccttactgcattttttaaaattaaaattctcttgcacgcatggcagcttcccaaggttcttccagagattcaaatgaagaaaacccaaagactctttggcaattggcagtcaacttcagccaggctctcagactggaggtgttgttggcagatgaccagcattgttttccctagaaagtgacacaaagacttgactttcctgctacttttatcattttccttcccaattcattgagttacatactttaagatttttgagaagctgccttttcattaatatatccatatttgcctttttttgtatggatgaccagtttccaaatgtcagaaagaagcagccgcagtttaaagattaggttaatatttaaattgtgtttccagagaaagaggagaaaccttgagattactgattacataaagcaaataactcatatagcaggtgttaattcaatccagggtgaatttaatttaccaggtgcatttataagccttaatataatatacataagcaatgagagcttaatagaacatttgagccttaattttattttaagaagaaaagaaaaaaggaaataaaactttaactttatgccagtgggattgttagtgttcaccaaacactgctggcttagaaaagcttttcgtccccgtgctatgctttttatggaccctggaaaataatgaaaagcattttcagaaaatgaatgattttaaagtactttttaaataagtgttgatgatggcaaa

SEQ ID NO: 54967 - DNA, 421 bp, Homo sapiens
tcgaggctgctgtcaccagaggggctgattttctaggagattctgcagagtggcgtgttcgtgcaacacctttcatttataaaatgctgttgattaatttaaaaacagaacaatactgtctcagccaaacatagcacattctttgggccatgggcttatgactcctgctgcagtagcgaacctgatgatgctaggtccagactggcagggcgtggggcatgttgtcccttctaatttacaacagagcccctgactaggttggaagccagtgtagccatgtgggtgtagcaaaatagatggaatgcaggctttcagttaatctgcacacgttcctttcaggatacagcagtcttattttgtaattgagaaaaaaggggagctcagagaggtacatagttggcagcgagtagcaggttttact

SEQ ID NO: 54968 - DNA, 496 bp, Homo sapiens
gtgcttcatagtccaccatcttcccggaattctgtttatagctttttaaataacagatttattgatatataactcatataccatacaattcaaccctttaaagtgtacaattcagtgggttttagtatattcagagttgtgcaaccatcaccacaatcaatttcagaaaatttttattactccaaaaaagaaacctttacccattagcagtcacttcccatttcctgaacccccaccccaactctatagccctagtcaaccactaatctataccctgtctctatagatttgcctagtctagaaattttgtataaatgaaatcatgcacttgaactttttgtatctggcttcttttcatttagcataaagttttaaaggtccttatatgttgctgcatgtgtcatttctttttgtgactgaatattacattgtatggatataccattttgcatattttgttaatccattcatcagttggtggacagcaggttatttc

SEQ ID NO: 54969 - DNA, 885 bp, Homo sapiens
catccttttaccacagcctcagccacagtacgtctaattatttaaaatttgtgattatcgctggtggtcaacaatttttttgtttttcatcctttaactggaaaaaggaggggctgtctcagtttttcttctgactctgtgtgtcacttacaattaataatgctagctgttaacatctacatagcagttgacatgtgccaggcctgtttaccagttaatcttctccatgatcctatgaggaaagtgctattgctgtctccatttcatagatgaggaaaatgaggcacagaggagacgttatgtagccactaccactgcaacttgctcaaacttccggccaagtcggctctagtccagacagcctgactcctcagcctgcgtctgtatgctgcctctcctaattcattatgtttattaataatttttccccgttttgttaacacttatgtttcaaaaacagtcatctttatttacattgactgatcatttcttttgtaatttcttctagtacttacaatagttctagtttcattaacatttcctatagactgaaaaaattttttaatctttttggaattttaatatagtcaagaaagtatctaaacttctcatttttcaaaatcttactgtcatttaataatccttcccttttccactgatttgtgacactataatagtaaattttacaagggcttgttttggttacttattcttgccctggggttatctttaaactgaccacagctttctaatatatttgatcgtaacttccaaaaactgtgtaatttttgcttatttgtcttgcatctagtcacttaactctcttttgcttttctaggcagatcctatattatctacaaataatatatttatttccttctttcc

SEQ ID NO: 54970 - DNA, 970 bp, Homo sapiens
ttacctgacctcggccggaggtcccctgaggactagggttgagattcaccggcgccagtcacggaatgaccccccgcatgacgaccgcgccgcaaatgggaacatacgagccctgccggaggaacccggatctgagaatgttccagccaagagtcaagaagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataacaaccggcacagcctcggcctgattaacacccagcctcgacttatgctcatattt

SEQ ID NO: 54971 - DNA, 681 bp, Homo sapiens
  misc_feature (69)..(69): n is a, c, g, or t
ctctgcctactactgcatttgatggactctgtgacggggtcacccacactgtgcccatctatgaggggntgccctcccccatgccaccctgcgaacctatgtcataggttcgcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataacctatgattgattctggcc

SEQ ID NO: 54972 - DNA, 335 bp, Homo sapiens
ggtcgactactactactaaattcgcggccgcgtcgacctctgggtgctgaagacagagggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54973 - DNA, 1811 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataacctatgattgattctggcc

SEQ ID NO: 54974 - DNA, 1767 bp, Homo sapiens
aaacttaggctagtagaggcggtgttaggcagcagagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54975 - DNA, 1807 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54976 - DNA, 1909 bp, Homo sapiens
ccggccgtgcagcagccgtgccgcctcggcctcccaaattgctgggattacaggcatgagacaccacaacgggctcccgatgttgtctttgacgtattcctctggacctcaatatttcctgtcagctggtaattagatctagaggcttgattaatctttgtatgttcatatgtgagaagaattcataggcggcggcccgtgtgctccgccgagccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54977 - DNA, 1461 bp, Homo sapiens
  misc_feature (10)..(10): n is a, c, g, or t
  misc_feature (22)..(22): n is a, c, g, or t
  misc_feature (36)..(36): n is a, c, g, or t
acctcctagnagtgatccccgnattttcactccggnaattgcaggctgttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54978 - DNA, 1086 bp, Homo sapiens
cagggttgctgtggcaggacccagtaggtggagcccacagtatgctgggacaggtgcttcacccagttcagccatgagggacaaatattcttatatccatccgtctcttctcttgtagagaagagacgagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54979 - DNA, 1026 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagaagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54980 - DNA, 828 bp, Homo sapiens
cccaccaccttcttcctgcttgcatttcagaagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54981 - DNA, 1867 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54982 - DNA, 1747 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgtacatctcgtctcttctcttgggggatcctctagcgtca

SEQ ID NO: 54983 - DNA, 2254 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgcagggttaacacctttaaactttctaatttgggcctccaagttagactggagggaacagagaccatggagggaacatctgatattggaaaaacatgagcttggatacagctcagctgaacaaagctattactatggtgctttaactgcctttagaccctttgcagaaatcaagccacccctgtgggctcagggctcaggtggagggttgcgggtttgggcgatccagagggaagacaaacaccctgaatcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggtaagcacctgccctcagttaccctctgctcatggccacctctgtcctctctcccaggatgattggtttcccttcctcagcaggtaagggaacagccccgtggtgtagggggaggcagagttagcctcccattcactgccccaatgggggtgggagctggcggggtagtttgttctcctttctctgtctgtctgtttttggttccggctctttaccttgtgaagattcttatcaactccggatcagattgttttattcctgtaacactcatgaaatgctacttgtggctatctgatcct

SEQ ID NO: 54984 - DNA, 1771 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacatagcacctggctgaccaggctgaggcccgcaggtctaagaccaaggaagcacgcaagcgccgtgaagagcgcctccaggccaagaaggaggagatcatcaagacttatccaaggaggaagagaccaagaaataaaacctcccactttgtctgtacatactggccactgtgatacatagatcagccattaaaataaaacagcctatctgcacatgggaccgagctcga

SEQ ID NO: 54985 - DNA, 552 bp, Homo sapiens
ggtcgactactactactaaattcgcggccgcgtcgacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54986 - DNA, 690 bp, Homo sapiens
gccagtgctgggctctccagtgtagggagggggagagctggggtggaagtggtcattcgctcactgattttccttttgaaactgatggctctgccccacagagctatttggctgtcttgggaagagccatctttggggacaataaagagtctccatccacgcaccacctgactaatgaggagtttgtgagccctccaggggggccctgccctgtcctgaggtgggtcttctccagcctgagcatgtcttgtctcttgtttcccagggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54987 - DNA, 602 bp, Homo sapiens
ggacatccagaaggtgcggcgaccaagaggcattagaaggtggtggttactagaggcactagtagtctctggtaacagaaggtgcttacgggggtctgacgctttcctgctgtaggaagggtaaccaatcatcttggcttcctggccctcgtggcaggcttcggtagttggcgatctcctgctccagacgtgtcttgaagtccagcagcatcttgtactcttggctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54988 - DNA, 689 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgtaaacaaccgggcattgtcaatctgcagaagtaatt

SEQ ID NO: 54989 - DNA, 700 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagaaccacgaggaggagatgaatgccctgagaggccaggtgggtggagatgtcaatgtggagatggacgctgcacctggcgtggacctgagccgcattctgaacgagatgcgtgaccgttgagatcaggcatgt

SEQ ID NO: 54990 - DNA, 501 bp, Homo sapiens
  misc_feature (10)..(10): n is a, c, g, or t
tcggctcggnaccgtttgacggaagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctggtgggccctctgtgctcttctcttcctgtcggatctctctcctctctgacctggatacgctttggtttctcaacttctctaccccaaagaaaagattattcaataaagtttcctgcctttctgcaaacataacctatgattgattctggcc

SEQ ID NO: 54991 - DNA, 220 bp, Homo sapiens
gcgtcgacagagggcccaccatcaggagagagtcaggacagggggtcctgagagcagagggactgagccgtgggccctctgtgctcttctcttcctgtcggatctctctcctctctgacctggatacgctttggtttctcaacttctctaccccaaagaaaagattattcaataaagtttcctgcctttctgcaaacataacctatgattgattctggcc

SEQ ID NO: 54992 - DNA, 593 bp, Homo sapiens
gtgagcgggaattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatccccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaaggtacccggccctcccaccccacatagcccatcccatatagccaggggggccgggcggacacagcctcttggtcaggctgctcgagctgagcttccccaccaccttcttcctgcttgcatttcagaagtgcagagctgaacaaggaggtgtctaccaacactgccatgattcagaccagcaagacagagatcacggagctcaggcgcacgctccaaggcctggagattgagctgcagtcccagc

SEQ ID NO: 54993 - DNA, 808 bp, Homo sapiens
cccaccaccttcttcctgcttgcatttcagaagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacatataccaaccggccgaagcctcgt

SEQ ID NO: 54994 - DNA, 1833 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54995 - DNA, 2016 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacatagcacctggctgaccaggctgaggcccgcaggtctaagaccaaggaagcacgcaagcgccgtgaagagcgcctccaggccaagaaggaggagatcatcaagacttatccaaggaggaagagaccaagaaataaaacctcccactttgtctgtacatactggccactgtgatacatagatcagccattaaaataaaacagcctatctgcacatgggaccgagctcga

SEQ ID NO: 54996 - DNA, 1769 bp, Homo sapiens
tcagtctagtagaggccgcgggtttaatcggccgaggagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54997 - DNA, 2462 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgcagggttaacacctttaaactttctaatttgggcctccaagttagactggagggaacagagaccatggagggaacatctgatattggaaaaacatgagcttggatacagctcagctgaacaaagctattactatggtgctttaactgcctttagaccctttgcagaaatcaagccacccctgtgggctcagggctcaggtggagggttgcgggtttgggcgatccagagggaagacaaacaccctgaatcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggtaagcacctgccctcagttaccctctgctcatggccacctctgtcctctctcccaggatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54998 - DNA, 2379 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgcagggttaacacctttaaactttctaatttgggcctccaagttagactggagggaacagagaccatggagggaacatctgatattggaaaaacatgagcttggatacagctcagctgaacaaagctattactatggtgctttaactgcctttagaccctttgcagaaatcaagccacccctgtgggctcagggctcaggtggagggttgcgggtttgggcgatccagagggaagacaaacaccctgaatcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 54999 - DNA, 1818 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcgacgccagccccccttatcttaccaaccaacgcagcccgcctgaatacaccgcgccc

SEQ ID NO: 55000 - DNA, 1460 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 55001 - DNA, 558 bp, Homo sapiens
  misc_feature (10)..(10): n is a, c, g, or t
tcggctcggnaccgtttgacggaagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 55002 - DNA, 1150 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaaaagtcgacgcggccgcgaatttagtagtagtaggcggc

SEQ ID NO: 55003 - DNA, 811 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagaatccgtggaaccgggcaaacccattggaaaaacaaacgtgggttccattccgtgggagatttgccaattgccaggggtgtgtctgggtggacagaacttcagggctcaaggtaatgaggaaatgggaggcttggcccctttggggccaagaagcgtggggagggccggaatcaacg

SEQ ID NO: 55004 - DNA, 658 bp, Homo sapiens
atcgagctcgcaccctgccatttactccatggctagggttatagatagctgggtggctggggtaaatgagtgaggcaggagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagaccacaggggtcctctagagcagc

SEQ ID NO: 55005 - DNA, 393 bp, Homo sapiens
ccggccgtgcagcagccgtgccgcctcggcctcccaaattgctgggattacaggcatgagacaccacaacgggctcccgatgttgtctttgacgtattcctctggacctcaatatttcctgtcagctggtaattagatctagaggcttgattaatctttgtatgttcatatgtgagaagaattcataggcggcggcccgtgtgctccgccgagccatgagcctccgcctgcagagctcctctgccagctatggaggtggtttcgggggtggctcttgccagctgggaggaggccgtggtgtctctacctgttcaactcggtttgtgtctgggggatcagctgggggccccccagccaagaccccccgccggggggcgtgccgtggctgggggg

SEQ ID NO: 55006 - DNA, 250 bp, Homo sapiens
tcagatgatccacctgactcggcctcccagagtgctgggattacaggcctgagccactgcaccaggcccaaacttccctcttctcattccacagacactagtcataatggatttagggccctcactagtccagcataacctcattttaacttgagtacatctgcaaatagcctatttcaaaataaaggtcacattcacaggttccaggtaaacataaattttacgggaacagcatttaacccaaagctgt

SEQ ID NO: 55007 - DNA, 430 bp, Homo sapiens
ggtattaaacaagaagagttatggaaaccttaaaaatctattattctggtagcctgtcaaattgttattcccaaatcgaaggaataaaaaaaaatttcaattctttgttatatgagcagccaaagtttactttgattggactttgaattgattactgtgctctttgttatccatcgattgctcactcatccattcaaacattcattgagggtttgctgtgtggaaggaccagaccattcatcttaaattagacaggaacaatacacaaaaaagcatccacatttctgcctttcacactaattataaaggaattttgagcagcacaaactagctacaataataaattttctagtctttaaaaaacagctttatgaaatcttcgatacatgtaagaaaatgagctcctaatgtcatgaactaaccatttaaa

SEQ ID NO: 55008 - DNA, 308 bp, Homo sapiens
tcttatactcaaaatgccccttccatacattatttttaaacatacgaaaatatattcaacttcacttattagaaaaatataatttaaaattagaccaagatcagaatgccaaagatcaaaaaaatctgaaatattagattggtgcaggtataggaagacacactctgatgccttattgatgggagtataagttgatacaacttacctttaaaaacaagttgcaatatctgaaaactctgaaatgtattaggccaacagtcccactcctagcaatttatcctacaaatatactcatatgagtgcaaaaa

SEQ ID NO: 55009 - DNA, 392 bp, Homo sapiens
gagagaaggagggaagaaagaggagagagagaaaaagaaagggaggaggagcaggagagagaagcctgtctcgcctactatagaattttcttctctcctctcaaaacaagttccttacacatttggctgaccgcatggtacacgtggctggtgtcagggttctgtctgaactctgtgattgaggagaccaacctgcaggagccactttgaagatgcttactactgacagggcaggatcccatgaggcaggcatttcagggctaccttgtccttggaattcacatttcttggagccctggaaggggaccagctgttcagctctgcctgtcttgtgaacaggttgcaatccttaggaaaggaagtatgactttttgcttcattctacaaagtct

SEQ ID NO: 55010 - DNA, 218 bp, Homo sapiens
atagattgttaatacttcaaaataaaaatagaaaaactcatatatcacatttatatcttaaaaatgagagatctaacagtgaagatttctacagagcaataatcagttacggtaaaagtgcaaaagaaaacattttaaagaaaaagatagaaatgactatttaaataaagtgtatacatcaaataaggtaactgataaagtgataaagaatatgtttt

SEQ ID NO: 55011 - DNA, 1167 bp, Homo sapiens
cgtttccagaatcacttagcttctttggctggatgaagcactagccatctcttgctttgacagggctttcctaacttcacaattgttgccattcacagtatgatatttctgaatgacagtcttatccacggagttgtggtcgtcaaaggttacaaaggcaaagccccttttcttgccactgcctcggtcagtcatgatttcaatcacttcagtttttcagaactgtttaaaataatctcttaggtgatgttctttagtgtcttctttaatgccaccaacaaatatctttttcacagttaagtgggcacctggtctttaagaatcttctgttgagacagctctctttggttccacaagtcttctgttcaccttgtgtgggccttgcattcatggctgcatcctccacctccacagtggcatatgtgacaaactcaaagcccctggagcacttggtgtttggatctctcattaccacacagtccgtgagtgtcccccattgctcaaaatggctcctcaggctctcatcggttgtttcaaagctcaaccctccaatgaagagcttcctcagctgttcgggctctttaggagacttgtgacttagacatgatggcatggagaagagagactttaatgatgcttcagcgtcatccatgggcagaaagctttttttttggagacagaatctcactttgtcacccaggctggagtgcagtggcatgatcttggcttactatagccttggcctcctgggctcaagctgtccttctgtgtcagcctccctagtagccgggactacaggtatgcatcggcatgcctgactaattttttaaatttttagtagagatgagatcaccctgtgttgctcaggctggtcttgaacgcctgggctcaagcaatcctccctcccttgccttccaaagtgctgggattacaggtgtgaaccactgtgcctggcctattttcaactttttcttatggtagttttcagttatatacagaagtcaagaaaatagttcagaacaaccccgtttgaggccgggtgcggtggctcatgcctgtaatcagcactatgggaggccgagacgggcagatcacgaggtcaggagatcgagaccatcctggctagtgcggtgaaaccccgtctctactaaaaatacaaaaaaaaaa

SEQ ID NO: 55012 - DNA, 742 bp, Homo sapiens
cttggggagccgttttgacgcaggggggggacattcacggacggtgtggtaatgacgcagatccacacaccaagtgctccaggggctttgagtgggtcacatatgccactgtggaggtggaggatgccgccatgaatgcaaggccacacaaggtgaacagaagacttgtgacttagacatgatggcatggagaagagagactttaatgatgcttcagcgtcatccatgggcagaaagctttttttttggagacagaatctcactttgtcacccaggctggagtgcagtggcatgatcttggcttactatagccttggcctcctgggctcaagctgtccttctgtgtcagcctccctagtagccgggactacaggtatgcatcggcatgcctgactaattttttaaatttttagtagagatgagatcaccctgtgttgctcaggctggtcttgaacgcctgggctcaagcaatcctccctcccttgccttccaaagtgctgggattacaggtgtgaaccactgtgcctggcctattttcaactttttcttatggtagttttcagttatatacagaagtcaagaaaatagttcagaacaaccccgtttgaggccgggtgcggtggctcatgcctgtaatcagcactatgggaggccgagacgggcagatcacgaggtcaggagatcgagaccatcctggctagtgcggtgaaaccccgtctctactaaaaatacaaaaaaaaaa

SEQ ID NO: 55013 - DNA, 441 bp, Homo sapiens
ggtccacacctggcagcatcggcatcaactctgaactgttagaaatacagattcttgggtcctaacattccagaattcctgaatcagaaaccctgaactgtgtttcagcatgcccaggttggagattctgatacatgggaaagtttgagaaccgctgctctaagggtatgtacttaggagtgggatggctgagtaatggtgtacaaacatacctgtttttactaaacactgctaaattactctccagagttgctcagctgctttctgttccacatcagtgcacaagggttcctgattccccacgttcttactcaaatttgttattaaccaactttctagttttaccaatgtttggtggctgtaaagtgggatctcattgggttttctttttgtgaacttatatgatttcttagtaaatttgaactcttttaatatattcat

SEQ ID NO: 55014 - DNA, 260 bp, Homo sapiens
tgaggcaggagaatggcgtgaacccgggaggcagagcttgcagtgagccgagatcgcaccactgtgctccagcctgggcgacagaacgagactccatcttaaaaataaataagtaaataaataaataaagctccatattttaaaagctcattatagtatttaagtagcagtgatgtttgaatagtcttttcatgccttcccttttactgatttccttgcgaatttgaaattttgactgtcttaagataatttagcacaca

SEQ ID NO: 55015 - DNA, 625 bp, Homo sapiens
attggaaggagaacgatcatggctttaacaaaaaaaaaaaaatgtttaagaaacttggaatctccaggaggctcattcaaaatcaatctcgatctctgtagatatatctccatgatcaggctaaggagcttaatttctcacaagcccccaactcatacagtcttctagttctcccctgcttggtgagaactcttgctagtgaaccttcctctcccacccccaacactggcttcttcttctttcagactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaaca

SEQ ID NO: 55016 - DNA, 1310 bp, Homo sapiens
tatctatgtaacaaatcgcagcacaggagtcccctgggctccctcaggctctggtatgacatatttgagccatataaattcagcttctcctctggcatctgttagccgactcacttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtacacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaaca

SEQ ID NO: 55017 - DNA, 2355 bp, Homo sapiens
tcgagatctgctgcattcagagcattgtgttaggaatattggaagtaaagcattgtaatagctcttgccttcagtaagcttgcagtctggcagttggattaaaaaaatgaccatacgaagccgtgataacagcctctaggagggaactctactatgtggtggagatatgtgtccccctgcaaataccaagaaagacagttaattagtgtccattacagaatgttcttctggtgtcctttttaaagagattcagtcagtctttaaagatgatgctattgctgctactgctaataataatagtgatagctaccacttactgtttactatgtaccttgtgctaaacacttgacataagttaactcgtttaatcttaaaccaaggaagtagataatgattctcattttacagatgaagaaactgaatagacagagatgaagaaatgtgcctaaggttacgcgatttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctcatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaacctaaatatgcaaaatgttaaaatattttcttattgaaaaataaaattatagaagatagtagtctgagaatgacaaatatgataaaagggtcaatacctgtactatttttttcagatgtgtagaaataaatacatcaagatctcaacagatatgtgtacaaaggaaatcataggccatgggaaattttaaatgtaaataagcatataaaaaaattcatgctcacatactgagagagatgccaaataaagtagacatttctacactccagccttggcaaccgtgagaccctgtctcaaaaaagcaaaaccaaagcagacatttcccatttatctatcttgcttactgtctatgtccttcattagaatgaaagcttcacgagggcagagctttgtctgctcactgctgagccctgcacctataacagtgccaggcacatagtacatgtttagtaaatatttactgatgaatgaataaagtcagggaaacaccagataggaatctgaaggagaataagaaactgccagaagcaagtattaattgcctcctaattactgtgaggaccctcccaagcatgctagatttgctgagcctgcagccagccccataaggaactcctgcatcctgtatgctgagcagagcacaaacactcataaactgaggcccatgcatggcgtgacaccacagttccacaccaaagagcaagagccataaaaacagaacagatactttctaaattgctttcatcaatcttactttgagaagaggattttttggctgaagcacgtgaacagaactgccaaaatccaaactttgtgagcagtgtttgttactcaaaattagtgaatacctcctttctcaacagcaaaatacagagaaatatgacaaatatgcattttatttaaaataactataaaactataaataaacctaatgcagttgatttcagagcatgctaagaacctttaaaagttattattctagccaggcatggtggctcacacctgtaatcccagcactttggg

SEQ ID NO: 55018 - DNA, 337 bp, Homo sapiens
tcaatacctgtactatttttttcagatgtgtagaaataaatacatcaagatctcaacagatatgtgtacaaaggaaatcataggccatgggaaattttaaatgtaaataagcatataaaaaaattcatgctcacatactgagagagatgccaaataaagtagacatttctacactccagccttggcaaccgtgagaccctgtctcaaaaaagcaaaaccaaagcagacatttcccatctaccaaaacagagaaattttagtgatagcctctgcttccttttcggagtatgtaagccaaaaggaaatgaaactttttatttaatcctcacccattttg

SEQ ID NO: 55019 - DNA, 957 bp, Homo sapiens
acacttccataaagcctaattcatctccaccaattcacaaaaaaatgccaagaaagcatttaccacatgcaatcactgttccaaagatttagagaggtttagaagagtgattgtaaccacaggctttggcgccatattgcctggtccaaatgtggctttggtgcatactaatcacagaattttagtctagttactggctgtgcctatctgtgcctcagtctccttatttgtaaaatgggaatgagcataagaagaataagtgggttgaaagtctacattgcctagaacaacccagcaaactagaagaacaccataagaatgcgtaattattattctttatatgtttataacattttttgtttgtttgttttaacagctccagacgcaggtagtatagtaatttttgccccatactgctgaatgttttgcctggcaaatactgggaatggggcaattcctgtggcagttttgttttccaataattgttttttcttatatcggggatgacaaatgcttgtcacaaagagtagccttgttgattacacttataaatcttcgggagacttcttcaatgagtcagtgttagagctttcagtttccataaatgcagatttcctttactcagtttttttttaaacatgagctgatctttcttagtttgcactataataccctccactgaagtctcactgcaactgcttttaattatatgtgaagagaaactagccctttgctaaaatagttgcatgtttcacgggccagtgagtcatttagtcatacacttaagaactttccacctttcaagtgtttatcatcacctcggatttcacggcctaatgccagtcaatttcatggggcatagaagccctgtacgtattagtttgggccattattgtatcagtcttgtttattcccagaaaagtcttatcaagaaaagagggagtgactataatcaga

SEQ ID NO: 55020 - DNA, 417 bp, Homo sapiens
gttgtgttatgtgcggctccgcctagcagaggcgttccaggaattggtgggcctttctatggcatgctttctccagctgtactcactgggatagcaagagagcaaggctttgaaccaagcttcttgcctctgaagaaaggctgccatccagaaccgccacctgggatgaggctgggcagggtcaggacaagaaacgctgctgcctgtccttggatcctggttactgaacagtcagtgtggaaaatgattaactggttcaagataattaggaaagagaatgattttgagagctggcatggatgagggagagaaacagtggactagggctccagctttaggcaagtgctaaatatcctaccagcaggaaggcggacagagtgggagatcagagagctgtctgggctattcagacccctt

SEQ ID NO: 55021 - DNA, 388 bp, Homo sapiens
tcagcctcttgagtagctgggaccacaggtgcttgccaccatgcctggctattttgtaatttttgtggacatgagttctcactatgttgcccaggctggccttgacctcctgggctcaaggaatcttcctgccttggcctcccaaagtgttgggattacaggcgtgagtcactgtgcctgatgaattgctgcgattcttgcttttaaattatgtaactgcagtttttatcatgggcaatacagtttactgtgagtttgcttaactctaaaacgcttagaatagtatcatacagaaataaattgctcaattatttgttaaataagtaaatgcacacaatcatgttatatgttggtttctgtccttctagtcatttttcccccatacatt

SEQ ID NO: 55022 - DNA, 169 bp, Homo sapiens
gtgtggacaagcctccgagggcctgaacaggaggcggggtcccaggcagaatggccaatgcggcctcccaagtttcaggaacaacccgtgatctggaagctttggaaactcttgaagacaaggagcaatgacctgggttggaccaaggattccagatccctgctctgct

SEQ ID NO: 55023 - DNA, 893 bp, Homo sapiens
  misc_feature (851)..(851): n is a, c, g, or t
ttttccacctcttttctctcctctctcctctgaatctgcctcttcctcttctcacctccctcttccttccctgtctctcccccttgggtctctcttccttccctctctctggtttctctgtctctgccctgtcctttcctttccctcctctctggacctgtctcctctcctggctctctctccttcaagctctcactcccactggcctccctcccgggagccccgtctcctccgtctccaggtggcccctgcatccctgcctggtgggcctttgcctccctctcctgttcctgccttgcctgctcccaggtttccaggtcctgaccaggaggcaggagtccataccgagggcccaaacaggctagccctgagcagggcccccaagcctgaggcccaggagtggacagacctttgtgacacccattctctcttccttttccatctgtccggaactctggacactgcctggaggaatcaggcctgccgtaggcccaggaaggcggaaacaaagacgacgctcagagacaggaagcaacttgcctaaagatacacagcacaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatcgcttaaacccggtaggcggagtttgcagtgagccgagatcgcgccactgcactctagcttgngcaacacagcaagactccgtctcaaatcaaaaaacaaaaaaa

SEQ ID NO: 55024 - DNA, 626 bp, Homo sapiens
taacccctcactaaaggaattaagcttcggcccgcccttcgttttttaatttttggttgggcattttgtaaaaatgaacatttttactcctaatcaatatacaaacatcatgctcagcaaacttcttggtatgaaacttctgaacttcacacattttcaagtcattctatgggtgggtggattggctcccatggaaatgcaactgggactgcacatgggaaacaaaggaaaatggaatttggttcacacaaacctgtttgggagattgcatttccaggaaatgggccaaattgagtttgtttcctttgtaacaacattgttgtgccttgctgactggaaggtgggtacaaataaaggaggatggactgacagctgaagaggcaccagtaattagcccctaatccttaccagggagtctctctgatgggttaaagaagcctacagaggccaggggcggtggctcacacatgtaatcccagcactttaggttttaactaataattagggtattactctatcattctctatcattcaaattctccaggtactgacctggtttttattttatttatttatttatttacttatttatttttgagacagggtctcactctgctgcccaggct

SEQ ID NO: 55025 - DNA, 1441 bp, Homo sapiens
ttttccacctcttttctctcctctctcctctgaatctgcctcttcctcttctcacctccctcttccttccctgtctctcccccttgggtctctcttccttccctctctctggtttctctgtctctgccctgtcctttcctttccctcctctctggacctgtctcctctcctggctctctctccttcaagctctcactcccactggcctccctcccgggagccccgtctcctccgtctccaggtggcccctgcatccctgcctggtgggcctttgcctccctctcctgttcctgccttgcctgctcccaggtttccaggtcctgaccaggaggcaggagtccataccgagggcccaaacaggctagccctgagcagggcccccaagcctgaggcccaggagtggacagacctttgtgacacccattctctcttccttttccatctgtccggaactctggacactgcctggaggaatcaggcctgccgtaggcccaggaaggcggaaacaaagacgacgctcagagacaggaagcaacttgcctaaagatacacagcacaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatgatctcaacaaaaaggaacagtgaccagaatgcctgggggaggaacaggggatactgggtggaaggaggggagagggagaagttgtaatattttgtaaaaatgaacatttttactcctaatcaatatacaaacatcatgctcagcaaacttcttggtatgaaacttctgaacttcacacattttcaagtcattctatgggtgggtggattggctcccatggaaatgcaactgggactgcacatgggaaacaaaggaaaatggaatttggttcacacaaacctgtttgggagattgcatttccaggaaatgggccaaattgagtttgtttcctttgtaacaacattgttgtgccttgctgactggaaggtgggtacaaataaaggaggatggactgacagctgaagaggcaccagtaattagcccctaatccttaccagggagtctctctgatgggttaaagaagcctacagaggccaggggcggtggctcacacatgtaatcccagcactttaggttttaactaataattagggtattactctatcattctctatcattcaaattctccaggtactgacctggtttttattttatttatttatttatttacttatttatttttgagacagggtctcactctgctgcccaggct

SEQ ID NO: 55026 - DNA, 198 bp, Homo sapiens
aggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatg

SEQ ID NO: 55027 - DNA, 565 bp, Homo sapiens
gaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaaccccatctcaaaaaataaaaacaaaaaacaaacaaaaaaaaatgtgatatcataagacagaccttttcccttctcatcagtgactggaattaactgcccatgtggaacgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaat

SEQ ID NO: 55028 - DNA, 190 bp, Homo sapiens
  misc_feature (6)..(6): n is a, c, g, or t
  misc_feature (123)..(123): n is a, c, g, or t
  misc_feature (130)..(130): n is a, c, g, or t
gttctnattcttcatctctcttgataaaccttcacagctttcgtatttggcttctgcttctgcaactaccctttagcattattcaccaggatttcattcccttctgttcttattttacatttnctttttnctttttttttaagatggagtttcactcttgtcgcccaggctggagtgcaatggcacgatc

SEQ ID NO: 55029 - DNA, 2012 bp, Homo sapiens
acaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaaccaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtctctcattgtaaa

SEQ ID NO: 55030 - DNA, 1248 bp, Homo sapiens
acaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaattgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtctctcattgtaaa

SEQ ID NO: 55031 - DNA, 369 bp, Homo sapiens
cataaatatgggggaacgtggactatgaagatactgaaagagtgcaagccaaaaaactgtgaaagagtttgacattcttcttggtcaacataatgatgaaatgcaagaactgtcaggcaatataaaggaagaatccaaatctcaaaacagcaaagacagagtgatttgtgagttaagagcagaggtaagacactgggtaaagagtaccatatatattaaaacataactgactgttgttaaatgccatactattttaagtagggtaacggtcgtgcctttggttactttatgaaagtgaatgctgctgctaatgtaatcagcttatatgtgatttaaaaggctgtggaatgacattggcccataactaga

SEQ ID NO: 55032 - DNA, 1841 bp, Homo sapiens
acaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtctctcattgtaaa

SEQ ID NO: 55033 - DNA, 1450 bp, Homo sapiens
acaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtgggaagttcccaccagcaaagaccttcccaccacacgtttctttttttttgtttgtttgtttgagacagtgtctcactctgtcacccgggctggagtgcagtggcatgatcttggctctctgcaacctccacctcctaggttcaagcgattctcatgccttggcctccagagtagctgggatggataggcatgtgccaccacacctggctaacttttgtattttccgtagagagcggt

SEQ ID NO: 55034 - DNA, 1029 bp, Homo sapiens
acaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggtatgggtgctccttggagcaaattctcactgtctaatctcactctgatgcctacgcagagtctgtcttcactcgtacacgcctccacatttggatatttccttttgtgccagctaatacctgatactccttgctcttttgcccactaggatgtaaaataacgttcatgcatctgaaacaaagtgtgtcaaatgttaaaatatgacaaatcttcagacagtttcaagatttccaaaaggaagaagaaaaatgaagtaagaaatagaactttctggttttttgtttcttattaaagctttgtctcagtattttctaagctaatgatcttatttccaataaagattttttcattaattcaag

SEQ ID NO: 55035 - DNA, 313 bp, Homo sapiens
tgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggctt

SEQ ID NO: 55036 - DNA, 257 bp, Homo sapiens
aaattgaaaaatagagaaaatgtggagaaaactagaatctctatagacagcgtcaatgcagcatcaattatatgaaccacttttgagcacaaagaactattgttttgaccttggaggcaatttggtcttcattaggtttagctgtaggatagttgatgttcattattccctataatgcttgtgatggcaaaaccttcacaaatttatatgatctaggtatgttttcaatccttacaacccaaataaccgatcataac

SEQ ID NO: 55037 - DNA, 389 bp, Homo sapiens
gcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggac

SEQ ID NO: 55038 - DNA, 1104 bp, Homo sapiens
  misc_feature (1063)..(1063): n is a, c, g, or t
atgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcgggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctnccgcgacgagcccttcaacttagcttcacaacagggactat

SEQ ID NO: 55039 - DNA, 242 bp, Homo sapiens
acacagcttcgtctgtttgtgggaatattcgtttcttaggtcttgtaaagttcttgatttcttccctcaagaaaaatacggaattgcatgcattcttccatcaatatttgattcattataataaatttatgcctcactgctgtgttccacacctttctacataaaaatatagccttttgtattaacaacatttctaaaaacattttattgtttgttttttgagatggagtttcgctgttgtt

SEQ ID NO: 55040 - DNA, 702 bp, Homo sapiens
ctgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacacccaaaatttgttttttgttttttgctttttttccttttccttttctctgtgatatcatgagcctgtaaggacaaatggcatatttgggcataactgcttgactctgtaactacttttt

SEQ ID NO: 55041 - DNA, 446 bp, Homo sapiens
tcacctgtaatctcagcactctgggaggccagggtgggtggatcacctgaggtcaggggttcaagatcagcctggctaacatggcaaaacctcatctctactaaaaaaatgcaaaaattagctgggcatggtggcatgcacctgtaatcccagctactcgggagattgaggctggagaatcgcttgaacccaggaggtggaggttgcagtgagctgagattgtgccactgcactccagcctgggtgacagagcaggactccgtcaaaaaacaaaacaaaacaaaacaaaacaaaactcatcattatgtgtagatagggaatgtgcaatgaggcatggtggattggtcaggactaagtttaaatatttatttttttattaaaaaaatagaaaaatgtgtccatgtcctaactgctggtaactgtgactatgacttcattttaaaatt

SEQ ID NO: 55042 - DNA, 439 bp, Homo sapiens
gtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatcc

SEQ ID NO: 55043 - DNA, 491 bp, Homo sapiens
ccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactc

SEQ ID NO: 55044 - DNA, 354 bp, Homo sapiens
ccagaatctaaacccagttctaaactgagccttttatctccaattatagagaaggttgaggttgcttatatccctggaagaaggaatacttgttcctggattatacactctggtatgaattaattatatcacattattctccaacccaagtatttttgaggggagaggaaagacagtatgaggaggaaagagatggtttgaggaggaaagaatgttagaagagattttgtgtgcctttctgttttgccaggaatcctctttccgaagacactgggggcttttcttcaatatgtttctaattcacagactaacgtgttatatctacgttaaataataaatattgatttctggatt

SEQ ID NO: 55045 - DNA, 365 bp, Homo sapiens
acagcccctgggctgggggtggaggggagcaggaggcctttcctgtcgctcctccctggcctctctgatgttgagtcatctcggcctctcaacctgctgccactaaaacagctgtttagttcttgatcagactttggggccccaaactggtttgattaaaatgtaacacctccctccccctgctccaaggaagaaggcctgagatttctggctcaacaaagccaacttcaacccgtctcaggtcctgcagcatgtggctggggactgctccatcaccacggtgcttataagaggaagagttcccatgacctgcagatggaaaggaggcccagagaggggcagccactagcccatgatcacacagc

SEQ ID NO: 55046 - DNA, 356 bp, Homo sapiens
cttccaggtcacaggtaggtgagagaaaaatagcttcattcttttaagtatctgattaggctttccaaaggaagcaatcagatatgcatctatcttagtgagcagagggatgactttgaatagaatggcaggcaggtttgccctaagcagttcccagcttgactattccctttagcttagtgatttgggggccccaagatttattttcccatcaaatttccccccttttcttttaaaaatatttggaggaagcattttagaagacagtgagtctctggtctggtctctcatggctaggacagtttattcctagatgggtaggttttaggttattaggaaagctcatttttagcagc

SEQ ID NO: 55047 - DNA, 324 bp, Homo sapiens
ggcaaaacagattgagaaatcatctagtggctggaattattacacagtaatttaaaactaactataatttgtttaacggcatagtagatgagataaatgggatgcatgaacagataaggactttcagagagattacaactttacgaaggagtcaaatggaaatgctagaaatgaaaaataccatatcagaaataagtaatttcatcaattagcctacaagcagactggatacagcaaaagaaaaccaatcagtgatcttgaagacaggtaaacaggaattatggcaatggtaacgcaaagaaaaaacgatggtaagcagtaaag

SEQ ID NO: 55048 - DNA, 886 bp, Homo sapiens
cctaaagataggagccctgtggtctgtttgataggttggcattctggggaggaggacaagtccctagattagatgccgtaacagtttgcagcactgagatccctgggctccagcagaacgattctatgtcttctagagtaacatggaaatagcagtgagcacatctggacctaatggagacatttggttcagtataacggtttgcatgtgctgataactcagcgtatcctatcaacccgatgggcccttggtggctcagaacatgaatgtgagagcaagcaacattaagaatcacctacccccttctcaacgcctaacccttgtatcagacccccactgaactttggagaactgggagcccaaactagtaattaaatcattacacaataataaagaaagttgcatttttcacacctgtgttggtggcctgcattttataccttgtgtagaatatttattttcttttcctcatgactgaatttccatggagttacaagaggacataacttctaggtatataaagactctttatagttctgatggaagcccacaaatgtttattgttggaaaagcaggcttcagcccacctggtcattaagtaaatgcacaaatcttggccaagactaggttttccatgttgagatgtagagaggcgattttgctgtcatgaaaggagtttgactaaaaacaaaagaaaacaaactgctctaacagcattagaccagctaatatttgctatttctgtatcccattaaaaaatatgcagatggaacagtgttagtgaacttcctggtcagaagaaaatcctgtccagtccaatccagtgcaaactaatttggagagcacatagtacttaatgagtaactcttgtgcctcttgttgctgc

SEQ ID NO: 55049 - DNA, 867 bp, Homo sapiens
ctgtggttccaggggagatccagaatgcatgtgtctcttcccacgcatttatgtcatgttggtagctttagatcagccatggtgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctctttctcacagagaaccacttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaatagaaaaaaaaaaaaaagtccacaaatttaatcacttgtagggaacccatctatcaaggtaccctaccatatacttttgtatttaatagattacttagaaaccacaaaaataggaatccttaccccttcaattcctgttcaaccctaaaaactgtgataaacgctcccaaccctgtggtgatcagggttatgtaatgttcaaagattcagacacacctgggtttggattcagttgcaactgggttgttatcacactcacttctttttagctgtgtgagcatgaataatttacttagcctctctgtgtctttccacctaattaaagaggatccaccccagggttattttgaggattcaaaaaggcatgcaacacacctggagcacaa

SEQ ID NO: 55050 - DNA, 464 bp, Homo sapiens
gtccccaacccaatgaccaaaaatctgaagtaggatctatattaagtttccaaccctggaacacattttccataaaaccatatagtaaattccataaaaataaaaccatgaccaatctccaaaagcttccttcaccaaaaaaacgtagctgaaaaaggagatggggtagcagcaatcagggacaggaaaaccaaagagtttgcttcaggtctttactctggtttaccgggaatgatgaccttggacaaattatttaacatctgtgagcttcacatttctcatctgtaaaacaggtatagtaatacctgcctaccaattttatgtagtgcacaagctcaaatgagactagaatacttactagttataaacagtcatcatccctactcctcctcctctctaacccaattgaaggctggtggaggaggtgagagagcacagaagcagtgggaggtttgggagccatg

SEQ ID NO: 55051 - DNA, 430 bp, Homo sapiens
aaaattggtgtttctgttgggcaagacagttctcttccaagaacccagcctccttccattttgtagctcctccagcttcaatgtacggtttccaaagttgctgacaaaggggtaagaagcatgaaggattgtgcctttttcaggcacattttcaagggccatggctggaaaggcacattgcatttctgcccacattccattgtttgtaactcagtcacatgactttgcctaaccacaaaggaacctgggtaatggagttaactatgtgcctaggagaggaaatgagtttggtgagtaagaaccagactttgccacagtacttaacctccacccagggacattctttcctccgactttctgattctttccaaatgctctcctattttcttcataaataaactcttgacccggaatagaataaaagtatcta

SEQ ID NO: 55052 - DNA, 181 bp, Homo sapiens
tgcaggtattttgaacatcagcagctgaggcaactgaacatgtttctgtgctgtcttgcacccacttctctttggaagcttcctatgtattactgcacaccttttccatgcctcctctgtcctccgcttcaaccttccagagatgctccagggtatcagtgggtcccatggaagactgtct

SEQ ID NO: 55053 - DNA, 279 bp, Homo sapiens
cagttttaggttcacagccaaaggtacacattttctgtgtacctccttgcctgcagacttgcgttgacttcttctattatccacatccccaattagagtgctgcatttgttacaattagcctgcacctaaggtccatactttacattgaggttcattcttggtgttgtttgttttctgggtttggacaagtttataatgacatatattcaccattacagtattgtacagtctcacttcactgaaaaccttttgtgctctaccttttaaagaagtttttt

SEQ ID NO: 55054 - DNA, 474 bp, Homo sapiens
aattctatcccatatcttattgaactgctttactcctaatttctctttatgatcatttcattactctagtagttttctatctcttcattttctaacttcactttttttttataaagagtttcccttataaaaagtatatagttgaattttcttttctgaaccaggcaacacttcattccatgaaatagaataagtgttcccaatttttttcttttatagagatgaagtcttgctatgttgcccaggctggctttgaactcctaggctcaaacaatcctcccacctcagtctcccaagtagctgggactacaggtatccaccactgtttctggcttgaatttttaatttcttaacccaatctgtcttttgatagaaaaatttaatccatgtctatttcatcagtggcatatttggatgtatttctgccatcttatttcatgttttctccttaaaatgctttctagacaccccacc

SEQ ID NO: 55055 - DNA, 287 bp, Homo sapiens
cttgccttaggggtctagtcaccttcaggtcctttatttgtcaaaaacttcatatttctccctgatattggggcagggtaagcaggggcacattagctgggctctgcagctcttcactccccctacagcttctagtcgttcctggggtacatgaggtattacctattccttagggtgcctgagaggattcttttggtggagccacgccttagagttgccattcttcctgccactagaggaaaatgtaattaatcacaccaaaggcagggaagacgtcccactcccag

SEQ ID NO: 55056 - DNA, 438 bp, Homo sapiens
cacatctgtgttctccatctgctctggaatgccctccctgccaacgcacagagctctccagcctcggggaacttgctgctttggttgggaaattccccttgggattaagcgttcctgccttcccgcagcactttcctagctcagagcaggctcacagaccgtgtgagtgtccttgggtacagaataccacaggcaagtgagatcattctccattgcatttcttttcaactacaatttgagtgatttttcagaagtacaagatttacctgattcttacatggaggtagtgatgtattattaaatacacagaatacaaaggcaaggatgggtggggcgtgcacctgtaatcccagcactttgggaggccaaggtgggagaattgcttgaggccaagagttcgagaccagcctgggaaatatagtgagacgccatatctac

SEQ ID NO: 55057 - DNA, 243 bp, Homo sapiens
tgacctatcaatgcagggggtggctcttgggttaaatcacttcctaaagagacatctccgtgccctgctgggaggcctatggtgaaccctgtgatagacctggggaccaggacttggtgaagggggcataggtctgagggaggaggtgcacaagagctccataccatgcaggctgaaactggagtcggctggtctagggcgtcccacaggactaggtgtgggtggtagagggtagcattgggg

SEQ ID NO: 55058 - DNA, 554 bp, Homo sapiens
actttcatccatttgcctgtaggagaatcttccagggccccagagcagtgcttgaggacttattacagatcctttgacatctctactaggctgcactttcacaaaaggcaagagtattataaagtgttttgtaactttatgtcaaaaatatgaacctgtcagagccagatgtggtggtacctatcattcaaactacaacagggctggtgaggcgtgaggatcgcttaagcccagcttgttatgattatgcatgtgaatagccaccgtagtccatcttgagcagcgtagcgaaacacagtctcttaaaaaaaattgcgacctatacatttcatataagttaaatacacatcttccctatgagccagcaatcccacatctaggtatttatccagagaaataaaagcatatatcgataaaaagacatgtacaaaaatgtccgtaacaactttattcatggtcaccaaaaactataaactgcccagatgtccatcagtgggagaacggattaataaactgatatattcatctaattaaatactactcagcaacacaag

SEQ ID NO: 55059 - DNA, 304 bp, Homo sapiens
aaaaaaaaaaaaaaaaaagaatccttaaatgatgggtattctctaaagcatgcggggcttaaaacctagatgatggattgataggtgcagcaaaccaccgtggcacatatatacctatgtaacaaacctgcacattcagcacatgtatcccaagacttaaagtaaaagtaaaaattaaaaaagatgggtattctatatttatctttcatgttacatttttctttgtggggtttctaaataaaacttgtaacatgaatgttttattctcattctgtattttaaaaagaagctgagtaacaaaagg

SEQ ID NO: 55060 - DNA, 1547 bp, Homo sapiens
agcgggtgcggcgcgcgtgggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccagccccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccacgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtataaaaccaaga

SEQ ID NO: 55061 - DNA, 1492 bp, Homo sapiens
agcgggtggtaaggaactcgggccgtgactgaccgggattacgactacccgcgagtgatatgtctatccgcgtgtgtcatagggccctggtcctatatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccagccccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccacgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtataaaaccaaga

SEQ ID NO: 55062 - DNA, 3090 bp, Homo sapiens
gaattccgggcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcacgggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 55063 - DNA, 4930 bp, Homo sapiens
tcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgccttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttggagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatattttaagtagagacagggtttcaccgtctgggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaatct

SEQ ID NO: 55064 - DNA, 4894 bp, Homo sapiens
tagccgcgggttaacggcacgagggctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgccttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttggagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatattttaagtagagacagggtttcaccgtctgggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaatct

SEQ ID NO: 55065 - DNA, 3125 bp, Homo sapiens
tgctgctccctcttcacatttatctggaccaaacataatcgtataaggggtcttgtcatggaactgatccaggttgagttctggtgttttagaaagcagtttcacataggcaccaccacattctattccattttggaaattaacctcatactgaacaatgagaggcttggtgtcaaacaggaagggcttgttcagtttagcagagatggcatgatgcttggcccgagacatcaacacaagtcctttatcacctggaagctttgactccttcatttcctctacctcccactttccatcatatttggcaatttcatcatcggtatcgtctttcttggctttggataaaatccaccctgacagagttcctctgtcaaaagaatcagcaaaatatacttcccctgttggaactggagctttgtaagtaaccttgggagatgaagaagggaggcagcagctgatgcctctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaatct

SEQ ID NO: 55066 - DNA, 3742 bp, Homo sapiens
tcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgccttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttggagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatattttaagtagagacagggtttcaccgtctgggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaagcaggttatgcttgcggcgcaa

SEQ ID NO: 55067 - DNA, 1841 bp, Homo sapiens
cacgaggaaaaatcccaagtcaccacagccagaaaacagacgtaggaggtgcctcatagctgccatgcccctaccacatgtgtcagcaggaagtcaggcttttctttcaaggccaagacactagaacagtgctgagcagggtaggtcaggaggcatttactctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaatct

SEQ ID NO: 55068 - DNA, 4211 bp, Homo sapiens
tcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgccttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttggagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatattttaagtagagacagggtttcaccgtctgggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaatct

SEQ ID NO: 55069 - DNA, 2374 bp, Homo sapiens
tcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgccttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttggagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatattttaagtagagacagggtttcaccgtctgggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccactaaaacaacaaaaaaaaaaaaccccggggcctcacatgcgggggcgcgggacacaacggggtacgcgaagcgccatgggccactagcggtccctggacccaggtttcttggcacaacgggggcaaacctcgccggacccccccataaaaaggagagccgggtatataaacttcgggaaagagcccggggttaaaccgcgtgcttaagtaagaggcgggaacaaaagagtaagcgcggcaaaacgaggagagacgaaagacagagagcacaaacgaagaggggcgaacgaccaaaacgaaaggcaaaacaaagaaaaggggcgaaggacaacacacaggcacagagacacgcagatagaacgagcacaaaagcacaaccaactaaccacacaacaaacagaaaagaccgcatcaaacacctaggaaaagccatcgacggacaccaggataagcaaaccacaacaccaacagtaggaaccgagaaagactgcaccacacaacaaccgccgaaccacccaacgagagg

SEQ ID NO: 55070 - DNA, 1562 bp, Homo sapiens
  misc_feature (17)..(17): n is a, c, g, or t
aggagtcagcggtggcnctttatgagagtcactttagtggcacaacagccatggagtaaatggcatgccatttactccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 55071 - DNA, 2765 bp, Homo sapiens
gaattccgggcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcacgggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaagttagttaactaaagagctttttcaagcacccatgtctgtaaaaaaatatttttaaataaagtttcttttgttgtagcagaaaaaaaatct

SEQ ID NO: 55072 - DNA, 397 bp, Homo sapiens
acatttgaaggttcttcggagccttaaggcccctaagcgtttggtcagatgtgataacccctgggcatggcattgagagttaggtttgtatctgttattgttattttgaaaaggttcaataagagcagaggctcagctgtggtaagaaagttgtttttcaacacttttctttactttccagagtatgaatagcagcccattagtaggtccagagtgtgaccaccccaaaatcaaaccttcctcatctgccaatgccatttattctctggctgccaggtaagtctgctaaagctatattttgtacagtggagttgttacttgtaaaaagcttacttgcagaaaattgagaaaacccagaaaagtgtaaaaaagaaaataaaaatctctgcaccatgta

SEQ ID NO: 55073 - DNA, 246 bp, Homo sapiens
tgtgtgcgacctcaaacctaggtctggcccatttgtagtttaagtgttcccatggtatttgccatccacagctttaggagagttgaaagatgccatttccccaaacgaaagtaatctgttaaattttttatgtaccctaggtggaacggccgccttctccattctccatggccccacaagcttcccttcccccggtgccaccacgacttgaccttctgccgcagcgagtatgtgttccctcaagtg

SEQ ID NO: 55074 - DNA, 1085 bp, Homo sapiens
acgaggatccccgcctgagatgacagtcggcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 55075 - DNA, 1185 bp, Homo sapiens
gaattccgggcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcacgggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatgggagcaagacgcg

SEQ ID NO: 55076 - DNA, 202 bp, Homo sapiens
cgtgagccaccacagccagtcagttttctcgtttataaaatgggaataatagcacctgtattgaagggttgttgtggagattgaatgggaatgtgtacttagaattccaggcatagtgcctgccacaagcactcaaggaatgagctggagttcagctgataataccaggcagtgtctctgggcaacacggaatgaagacaat

SEQ ID NO: 55077 - DNA, 277 bp, Homo sapiens
ctcagtcatcatgaccaccagcttgccctccacagttgctaatgtctagccattccttatctattggcaaggaatgcaaatggaatcagttctttcttttggggctgaggtaatagtggaatgctcccttacaggaagctacccaggacttcacaggccctgtgccagtgacttccttgaaaccaggaatattgatttgcagaaaagctgtcagtccagtcttgattctgatatctttctacaatatggcttcagacacttaaataggaaatgtgtg

SEQ ID NO: 55078 - DNA, 388 bp, Homo sapiens
agtctgttctcttcacggaatattttcacctgaatcagtgggtataattcatcagtgtctggttgcttcaagttatttttcttaatgctgatgttaatgcatgcccatctttatgcctcaacacattgcacaatgaaaaacaaaaattattttggaagacacagctgacatctatatgaaatattcagtatcagtgattgaacttcagcaagctcctgtggccagcagggttttacggaggtgcaactgctctcccacgatcacttatcataaagccagagacaattgggccaatgtagcctcttgcctgcttttgtgtacaaaatataaatagaatagagcaaataaggaaaaatagtcccgcagctggaaggcaactttaaagaaa

SEQ ID NO: 55079 - DNA, 311 bp, Homo sapiens
gaaaatacattcaatgcttgccagcaatttacctgtttatttttctgatgtttgtctctctcctagtggctcacctatatattgacactgcctttagaatttgggtgtcgtggcttcattgttgcatctgtgctcctctttccctactaaatgtcctttatcagggacggagccagcagcatttgcttgttctcagcaatctgagtctctggtcttccttgttccctgtttgggggcttctgcattgccatttggtggtggtggtggtggtggcagtgatgtatctgtgtttgcttctgtctgttccagct

SEQ ID NO: 55080 - DNA, 319 bp, Homo sapiens
tcatgttcacagcacatcccagtgtgaactagtcacaatgcaagtgttcagtggccacaagtggctagtgacaactgtattggaacccatagctccagactctgttcaattatctgtgctatcctctcgaggtactccttcctcagaaggagcctagacctggagggagatgcttgggcaacaatcctgctttgggtgaaaagctaagtccctgccacttatcaagcttccagaacacccacacctttagcacagcacaacctgctgcccccatttaacttaacaggtgttttgccacttgccaggaaggttcaatttg

SEQ ID NO: 55081 - DNA, 294 bp, Homo sapiens
aagcaggaaggacacactccataagtctcggcactgctcatcagcccatgtgtcagcacgctcttgctgatgggagcagcggggagaaacgccatactgggaagtcactgctggtgtgggacaagttacaagatgcttctgggggaggaaaatgtgtatcatcaactcctcaggtctggccaacttgctttatttcctttagcccccaaagggtggagcattgaagcataatagcttcaataagctttgttattttaacattattattttttaaactgaattcaccaccacagg

SEQ ID NO: 55082 - DNA, 175 bp, Homo sapiens
tagttgtaactttgaagcctttttatggatcaacatgaagattgagggatctcaaacagaaagggcatcctggtggcaaaggttaatcattaccagactgcaagagtagtttcaatggcaagaaagcagcaacagaatcaatgaaaacaaagcaatgattagaatgccctttccc

SEQ ID NO: 55083 - DNA, 395 bp, Homo sapiens
aggctcaaagtctcaggtggtatccagttggactcaaagatgtcccagtgctcaggaaatgctctttgagttaaggatcagcaagaaaaaaggaaaaagatgtgcaaacacacagggaggggaggcgaagtggagagaatgagggggaggttctccatcaagaaaccacaatacttaagcaatggcattcaggacagaatttctagcccctctaaagaaaagaactaatagcagcgttgccgctgtcccagcaaatccagtaagttctccagaatcaggaaagttcttcacagctcatttgttccctgactcttctgtgtccctccttttaccctttctcatgagagctggtttgccctgcctggcagcctgcagcaggcaccttgcagtgttct

SEQ ID NO: 55084 - DNA, 946 bp, Homo sapiens
agagaacctgcaaccgtttccgcctcctgctagagcggcgaaccgtgggcagtgaggtaacatctggggctgacgcccagggagccaggtctggctagtccctgggggtggccggggggtccagcctagggctcgaggagcgtagttggaggtgggcaagagagagagagtagggctgaattcctggggtggggggaggcagtctggcgttttgtgtcccatctcacgcagcctggcaccttcctctcccagcagcgctctgtcacctgtgcccctcatgttcgtctcccactttcctctgtgctggcctcctctgccctgtcccagcattctctaagcctgtgctccaaccccgctcatctcatggctttctttgccccaccagcctgactttttctccaaactggcagccatgtttaggggcttgatctttcacagcagcaggagcggtaaccgagaggtaagggtcggctctgggagcggggaactagtacgagcaaggtgtagctgcgccagagcccaggtgacagagcccgccactcagtcactcgtgcatcagatagatattgagcacctgctttactgtgaggacccagagggacataagtgcagacagtgctgactctcccaggagtttactcgtgagtaggggtggcagagaagccatgtgtgtaaaaatgcaaggtagaaagggctttgtctcactgatcctgaggagcaaggtaataatgtgggctaaggagatcgaggtcaaggaggtgtcacccaggtgtggctttgatgaatggggtgtgatttgaagatatgaaccagggcacaggataggaggcaggaaagacaacaggctggggaatagcagtgagttccttagttatgctggagctatgctatccagtacggtggccagtagccctatatggctatttaaattacaactaaatcaagt

SEQ ID NO: 55085 - DNA, 1999 bp, Homo sapiens
  misc_feature (1025)..(1025): n is a, c, g, or t
gttggcctactggaaaaaaaaaaaaaaaaaaaaaaaaaaaaaaaaaactaaaaaaagagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaaggtaaccaggccctcccaggcctgggtcgcaagcggtcctccaatttggccagcattcatgagactactttttgtcaagcatcctttgggaccaggcctagaacagaaatgttgatcaccctggagggatggggtggtgaggtcaggctgactttgtcagcctggggcccacttagctactcggatgggtacccttgctgggtgagttttctgcagtgtttttctgtgcacctttcaggtagagaggctccctagaatcgggagggcagctccacctggggcctgaatctagggacctgattggtggggcccttgctgctgaaggtggcagtagcacagtaagcactggcttctggtctcagccaagcttctgggacctggtcttgccttaacccctccctgaatctagagctcaaagagaagggaaaacagaagntggctgggagccgttctcccacaacctgaagagaaaggtgttattgactccactttctcaaggaacacaggagactaagacaggcaaagatgcagcccagggagggaccatgtgggggactggtctaggtagtgagtccccacttggagcctctgtgatcccagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55086 - DNA, 2449 bp, Homo sapiens
tagcaggctggtacggccctggatttttggattaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55087 - DNA, 2544 bp, Homo sapiens
agcaggctggtaccggcccgagtggttaggatctgcggcgctaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55088 - DNA, 2638 bp, Homo sapiens
agcaggctggtaccggcccgagtggttaggatctgcggcgctaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55089 - DNA, 2492 bp, Homo sapiens
cgcgcaagcgcagtgagtactgcacgttgtcgcgggccagtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55090 - DNA, 2568 bp, Homo sapiens
cgcgcaagcgcagtgagtactgcacgttgtcgcgggccagtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaagggtcccgctctgtcacccaggctggagtgcagtggcacgatcttggctcactgcagcctcaacttcctgggctcaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55091 - DNA, 3067 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
  misc_feature (2093)..(2093): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaaggtaaccaggccctcccaggcctgggtcgcaagcggtcctccaatttggccagcattcatgagactactttttgtcaagcatcctttgggaccaggcctagaacagaaatgttgatcaccctggagggatggggtggtgaggtcaggctgactttgtcagcctggggcccacttagctactcggatgggtacccttgctgggtgagttttctgcagtgtttttctgtgcacctttcaggtagagaggctccctagaatcgggagggcagctccacctggggcctgaatctagggacctgattggtggggcccttgctgctgaaggtggcagtagcacagtaagcactggcttctggtctcagccaagcttctgggacctggtcttgccttaacccctccctgaatctagagctcaaagagaagggaaaacagaagntggctgggagccgttctcccacaacctgaagagaaaggtgttattgactccactttctcaaggaacacaggagactaagacaggcaaagatgcagcccagggagggaccatgtgggggactggtctaggtagtgagtccccacttggagcctctgtgatcccagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55092 - DNA, 1898 bp, Homo sapiens
atcagtaatgctacttatgaacattcatgtcaagttttaatgtggaaataacgttttcaggtattttgatttatgcctaaaagtagaatttctgtttggcccaagttggtcttgaactcctgggctcaagcgatcctcttgccttggccttccaaaatgctggtactacaggtgggagccaccatgcccagctctggcatggtcctttggaataacgttcagtggtcttgtgtgtggggatgttggtagagctgcaacagtgactgaaccaccttgttctgaggcattaggatggtgctttctcccagcttgagggaaggcaagctgatccacctggcctggtttcgttgcggcctcctccctctgcctccttcagggcccctgggctctccctgttctccctgcaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55093 - DNA, 1733 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
  misc_feature (1589)..(1589): n is a, c, g, or t
  misc_feature (1594)..(1595): n is a, c, g, or t
  misc_feature (1599)..(1599): n is a, c, g, or t
  misc_feature (1611)..(1611): n is a, c, g, or t
  misc_feature (1618)..(1618): n is a, c, g, or t
  misc_feature (1620)..(1620): n is a, c, g, or t
  misc_feature (1624)..(1624): n is a, c, g, or t
  misc_feature (1629)..(1629): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcgacgtgcccnagttnngggnacactactgttnggcgacngngacntgtgnccgttggagactctggggggtgtgttggggggggccatccttcacgttgtaggggggggcggccgcccctgccccccgttgccttggtggtccccggtcacata

SEQ ID NO: 55094 - DNA, 1405 bp, Homo sapiens
agcaggctggtaccggcccgagtggttaggatctgcggcgctaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatccctccacagtcgcgccggatacacgcactgggcagaggtccgatgagcatggccttgatcaagacgaatgatagaactgaactgctgactacccctgcaccacggaaacagataaccagaaggctcagcgcgaagattggtacttggactccacgcacacacaattgggcccctgcattgtaactcacaacacgcatatccggtcatcgtacagctaatgaccctacctcaccattaggtgatttctgtcccaaactggatattcccccctgttcacacgcacgacccactgtcagatggtagtcagtacaaggactcccgtgctcgttcgaaatag

SEQ ID NO: 55095 - DNA, 219 bp, Homo sapiens
ggctctgcctgtggccgcttgctctgagttcttgctgtcttctcttgcccgaagtaaatatttgcctcagaaaggaaatgtttcacaaacacctcatgctctcctttctccccacagctgacattagtctgtgtctgttttgtttaggggatcatcttggctggcactgaggagcagaaagccaaatacttgcctaaactggcgtccggggagcacatt

SEQ ID NO: 55096 - DNA, 661 bp, Homo sapiens
catgttatgggtgagaaaggggtagtttagagagctgaagggatttggtgaaggccacataatgagtaagcctgaaatcaaggaccagacccccaggcttctaaatgttagtcttgggctccttgtttcatgggactattatcatcccttgtactgagaaggaaaactgatgaaaatcgggaagaacctatttgaacaggggagggagatggatgtgggtggtggagcctgcacatagtttctgtatctcaggaaccttgtgaggtttgctttccagttccttcagtacgtcatgtcccgctggccagggtggagtggagcacatgtttttccttcccttttaactgatatttccgtgatgggagtgtgctaaaaattaaattttttagaaaatatttactatttttagaaagaagttttcccatttccagaagttagccaagatgaacttaatgaaatcaatcagttcttgggacccgtggaaaaattcttcactgaagagggtatgtatggttttctttaccattgccgatttccattgtaagggctatttggttgatatttatattagaagtgacatacataggagaagtcttcttgagggagaaatggtttccactcataatattttgctttaggtttcatccctattgccatttaa

SEQ ID NO: 55097 - DNA, 2468 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55098 - DNA, 2462 bp, Homo sapiens
agcaggctggtaccggcccgagtggttaggatctgcggcgctaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55099 - DNA, 2446 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55100 - DNA, 2466 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaagagatggggggcggggggagggggggggagggggtggaaatgttctattataaaaaa

SEQ ID NO: 55101 - DNA, 1759 bp, Homo sapiens
aattaggctagtacgaggctggggttgaatcggccgaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55102 - DNA, 2572 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (9)..(9): n is a, c, g, or t
gncncgngnagtaacgtcatcagacgtgtgtgtccctgcggcgctaagaagtaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaagggtcccgctctgtcacccaggctggagtgcagtggcacgatcttggctcactgcagcctcaacttcctgggctcaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcagtttcttgtgttttttctgaacactccaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55103 - DNA, 1458 bp, Homo sapiens
ctccgccagcataccagcagcgtgaaagtctgtcagaatgatgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55104 - DNA, 1344 bp, Homo sapiens
ttaattgggaacacccattaaccgcggttgcgaagcgaggctacatcgtgcgtaaaattagccctcggtggaaaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55105 - DNA, 1634 bp, Homo sapiens
  misc_feature (660)..(660): n is a, c, g, or t
catacctggaccttctgcagtgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaaggtaaccaggccctcccaggcctgggtcgcaagcggtcctccaatttggccagcattcatgagactactttttgtcaagcatcctttgggaccaggcctagaacagaaatgttgatcaccctggagggatggggtggtgaggtcaggctgactttgtcagcctggggcccacttagctactcggatgggtacccttgctgggtgagttttctgcagtgtttttctgtgcacctttcaggtagagaggctccctagaatcgggagggcagctccacctggggcctgaatctagggacctgattggtggggcccttgctgctgaaggtggcagtagcacagtaagcactggcttctggtctcagccaagcttctgggacctggtcttgccttaacccctccctgaatctagagctcaaagagaagggaaaacagaagntggctgggagccgttctcccacaacctgaagagaaaggtgttattgactccactttctcaaggaacacaggagactaagacaggcaaagatgcagcccagggagggaccatgtgggggactggtctaggtagtgagtccccacttggagcctctgtgatcccagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 55106 - DNA, 413 bp, Homo sapiens
acggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaagggtgagacatttccaagacgggggacccttggaaatgtggtggtgacgtgttccagctaaattttgtcaggggaattcggaaaactctaggctaggtaattaacaaagcagccttcat

SEQ ID NO: 55107 - DNA, 266 bp, Homo sapiens
cattggctcataccttctgtcctctgatcatatttctgcaacactgtccataaaaatataatttttcctctttctttgggtcttcatttctgaaggcttctgtgtcacataaatttaaattaaataaatgtgtatgcttttctcttgttaatctgtcttgttataggggcctcagccatgaagtttgtgatgggtgaggaaaagctatcactggtccccaacacctttctttgtgctgtgtgccccgcacacaacacatgcttctt

SEQ ID NO: 55108 - DNA, 291 bp, Homo sapiens
cttgggctctttttaaggtcctggtctctctttttttaatatatttttggtttccccagaagccaattccgaggcaaggattaaagttcaagtggggctgggcacggtggctcacgccggtaatcccagcactttgggaggccgaggcgggcagatcacgaggtcaggagtttgagaccagcgtggccaacatggcgaaaccccgtctctactgaaaatacaaaaattagccaggcgtgatggcaggcgcctgtaatcccagctactcaggaggctgaggcaggagaattg

SEQ ID NO: 55109 - DNA, 344 bp, Homo sapiens
tgcatacctttggagagagattaaaatacttgctgaagttaagtcaatattgtcaactagattctaggcctcttgaagatgtgcaccgggtctcagttctctctcccgacctctgtccacatagctccagtctgatggtccacaggcttagtgagtgcatagtgctgagtctgaaggactaaagtgtcaaggacaatgcttgtgccatgccgagagaggtgaaaagagtttgctccagtggctactaaccagaagcgactgagggctaattaacatatattcgacttgtgattctcgatgtgcatattatccattttgcgtagagatagaatattttaaaattc

SEQ ID NO: 55110 - DNA, 2030 bp, Homo sapiens
ctccgctttagcagcggcgaagggaggacccccgggagccggtccccggcgtccggtcgcccagcccttttcaggcttgggcccgcatggaggggaccgtggagtcccagacgcctgacctgcgggatgtggagggtaaggtgggcaggaagacccctgaagggctgctccgcgggctgcgaggcgagtgtgagctgggaacctctggcgccctgctgctcccaggggcgtctagcaccggccacgacttgggggacaagatcatggcgctgaagatggagctggcttacctgcgagccatcgatgtgaagatcctgcagcagctggtgaccttgaatgagggcatcgaggcagtgcgctggctgttggaggagcgggggacgttgaccagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggagttaacagatgaagagatgggggcataattacttcacccaaagtctagaagccttggcctctctcttggccaagatggaggattgaggagggacatggaccttcaggactaaccctctatggattggccctcccagaagcgtttgggctggtagacccaccccttcctacctgctgagtgatgtcatttcctgccaggatgggtagccctttgtacgggtccttggatggtagtaggtcatataggggcatctgagcccctgctgctaagtgagatcacattatttatcgtccataccattacttcttgtgaacagtaacatgtcactcctcctggcaggaaagtttctcattgtcagatgtttgtgcttcttttcaggtcttactttttaaatagagtgttctcattttatcctaggggatctcacttcctctgtggctccatccctgcatccctgtctgggccagcactcctgactgcttttagggagagaagctttcaggggcctccatttatttctctcaagtctgtttggctcaccctgccatggtcccctgtcttaccctgtccctgtgttgcccctattcctgtattccatt

SEQ ID NO: 55111 - DNA, 1361 bp, Homo sapiens
agttcgacggagactctcatcctcgggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggagttaacagatgaagagatgggggcataattacttcacccaaagtctagaagccttggcctctctcttggccaagatggaggattgaggagggacatggaccttcaggactaaccctctatggattggccctcccagaagcgtttgggctggtagacccaccccttcctacctgctgagtgatgtcatttcctgccaggatgggtagccctttgtacgggtccttggatggtagtaggtcatataggggcatctgagcccctgctgctaagtgagatcacattatttatcgtccataccattacttcttgtgaacagtaacatgtcactcctcctggcaggaaagtttctcattgtcagatgtttgtgcttcttttcaggtcttactttttaaatagagtgttctcattttatcctaggggatctcacttcctctgtggctccatccctgcatccctgtctgggccagcactcctgactgcttttagggagagaagctttcaggggcctccatttatttctctcaagtctgtttggctcaccctgccatggtcccctgtcttaccctgtccctgtgttgcccctattcctgtattccatt

SEQ ID NO: 55112 - DNA, 987 bp, Homo sapiens
  misc_feature (926)..(926): n is a, c, g, or t
ctccgctttagcagcggcgaagggaggacccccgggagccggtccccggcgtccggtcgcccagcccttttcaggcttgggcccgcatggaggggaccgtggagtcccagacgcctgacctgcgggatgtggagggtaaggtgggcaggaagacccctgaagggctgctccgcgggctgcgaggcgagtgtgagctgggaacctctggcgccctgctgctcccaggggcgtctagcaccggccacgacttgggggacaagatcatggcgctgaagatggagctggcttacctgcgagccatcgatgtgaagatcctgcagcagctggtgaccttgaatgagggcatcgaggcagtgcgctggctgttggaggagcgggggacgttgaccagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgagcctgtgtcagacacaggctcaagatggataaataccacgttttcacacatatgtgggagctaaaaagttgacatcatagaagcagcatagcattggctgggcacggtggctcatgcctgtnatcccagcactttgggaggccaaggcaggtggaccatcttgagcctgtgtcggggatcctc

SEQ ID NO: 55113 - DNA, 180 bp, Homo sapiens
gggaaatgagatgggctttatgattggagcactgactgataggatggtatataagaagtctggtggagaagaaagcgaatgctttctaccagcagagctgctgcacagccgacagggccctgcgcgtcctgtttttgcagagggtggacaggccagcttcgcatgcctaaagggaacagt

SEQ ID NO: 55114 - DNA, 248 bp, Homo sapiens
tttacttaacaatcattttcatttgaaattccattttaacaggactggttactgataaacttaagaaggttccaggcttgaccaaagggagaccgaccctaactggccctaatctctttgccacagcagtcagcatacccgtgccacagataagcgaaccaaggtttagtgtgtgtggtgaagcactagagctgtttccctgtcagaggcgccaacagccaagagcccacgacagccagccaggggcc

SEQ ID NO: 55115 - DNA, 535 bp, Homo sapiens
tgagtaaaggaaattacattatattacataaataaatgaagctttaattttgttctccatatttctcaacagctttgcagatggtattaagaaacagggcatctgtgtctccctgtggaaaaacccaggctcttctggaactgtgggctccttgtgttgctgtcatgtaatcaagaagctagagcatctgcccattatcacatttctaatgttgaagtggagatatgaggattttgaaagttcccaattggatgcctctaaaggaagtgagggctctttcaagtaagaaaaactcattttatattaccttttaagctagctgttattaattttcaattttatgctagaaatttgcaactcacaaaaagaaaggaaaaaagttaaaccctgattttaaatatcattgttccccatttttcatgtctcagttaccacatttaaaaagaagatggcaccatttgtccaaggaatctcattactgggtatatgcccaaaggaatataaatcattctattataaagatacaagcaagtgt

SEQ ID NO: 55116 - DNA, 411 bp, Homo sapiens
tcttttttttgagacagggtcttgctctgtcacccaggctggagttcagtggcccatccatagctcactgcagcctcgacctcctgggcttcaaagtgatcctcctgcctcagcctgccaagcagctaggactctttgcagatggtattaagaaacagggcatctgtgtctccctgtggaaaaacccaggctcttctggaactgtgggctccttgtgttgctgtcatgtaatcaagaagctagaggtagcagaacccaatccttacacccaaaacactagccaagggcatctttctctcttgcatctagctatgactccaaaagagaagagcaaatggtcgctacatgcaaaacaagttgccaaccaccataggttttgtctttcaaattatcaaatatatgtatacatac

SEQ ID NO: 55117 - DNA, 536 bp, Homo sapiens
ttaggggccaatttgttcagctaggccaaggtgctaggcaggtactgagaagaccacagatcacaagggatgctctattttttaaatatggataaccctttccttaataacaaaatttccagcctatgttccgattatcaagtgagtcattctgaaaaccctgtttatttctctttcacccaaagcatctgcccattatcacatttctaatgttgaagtggagatatgaggattttgaaagttcccaattggatgcctctaaaggaagtgagggctctttcaagtaagaaaaactcattttatattaccttttaagctagctgttattaattttcaattttatgctagaaatttgcaactcacaaaaagaaaggaaaaaagttaaaccctgattttaaatatcattgttccccatttttcatgtctcagttaccacatttaaaaagaagatggcaccatttgtccaaggaatctcattactgggtatatgcccaaaggaatataaatcattctattataaagatacaagcaagtgt

SEQ ID NO: 55118 - DNA, 381 bp, Homo sapiens
gtctgcctggggctggtaatcaggaagttcctaaacagctccgaattctgcagtaaaaagtgagcctccgccttggaggagactactggttcgcccatctgtttggagtttctgttgttgctattgttggtttgttttcaaatttcattgtgttttcttctttgctcaaggaaggtgctgcaaaaccatagggaaaaagttcactgctacaaagggatcccaacccactggaggctttgaagtagggaggttggcaggggtggtcaagcgggagggagatagtcacttgttcttgcccctggaaaaaattcaggtgatgtctttgacatccagggatttctcaaaggcagtgagtaaaatcccaaataaagccccaaagag

SEQ ID NO: 55119 - DNA, 630 bp, Homo sapiens
tatgttgcccaggctggtctcaaagtcctgagctcaagcgatctgcctgcctcgtatgtctattccgatggaatctgcagcagtggttctcaaagtgtggtccaggagatcattaaaaccttttcagggagtttgcaaagtcaaaactgatttcacagtattactgaggtctatttttccttttcactctcattctgtaccttgaagttttccagagactgcatgttctgatagccacaggctaaacgcagaaactgtcttctattaaaccagacattaaagagatccacaaaagtgtcaaacagtggccactttttttccaatgttttttgctttgaaaaacataattatttatcataaaatatgttgtcttcacgtattacatgataggttttcattatttttaattaaaaaaaaattttaatttttctccttcttattttctgatgtggtaaatattgacagatataatccctataaaccaaagctctttgtttttctcacaatttttaagagaataaaataattcttagagtaaaaagtttggttgggtgcagcgactcacacctgtgatcccagcactttgggaggccaaggcaggaggatcacttgaggtcaggagtttgagac

SEQ ID NO: 55120 - DNA, 410 bp, Homo sapiens
tcctggcgacgtggtcccggtaggagacttagacctgagctggatctgttgaccccaaattgtgcttttcccaccaagaagaaagacagggagagaaacattagtacaagtgctgaactaaaatatagcagagaagaaacataatctctgaaatcacacagctattcggtttcaaagcgttcctagcgcccagctctcctaactcctggccagtgttcttgacattatggtaatacataaagactttgtttccgctggtgtgtgtctgtgggaagcctctgactcacctccgtgctccagtagcaccctgtgcagccttccaatgtcgcccttattgcgtggcgcggaagataatagtttggatttcctctgcaagtcagataatagctgtatccacttactggcacagt

SEQ ID NO: 55121 - DNA, 276 bp, Homo sapiens
tcctcctgtgaccctgggcatgggcttggacagggctctggaaatagatttcctatagcagctgcttctgcaaggactgcagaagaagcaaaatggtagaaaagcctccaacattaaaattttatctctccgatttcactggaacatggcagggagctcccccacccaagcttcataaataaccactgcacttccagaaggctctccctctacatattgagagtaattttaggttactgctctgagcttcacagaagaaagctgcttctccaaaat

SEQ ID NO: 55122 - DNA, 297 bp, Homo sapiens
  misc_feature (230)..(230): n is a, c, g, or t
  misc_feature (252)..(252): n is a, c, g, or t
gccagcgggcatgagtcatcctgtcccctgcccgggccccgaggctctggggttcccaggctgaggaggaacacacagctctcggttccccaacccggggtctggcccactccttcttccttctttttgcctctctgtcagcacctcttcctgttgcctccctcttgctcctgggcctgcctgcatctcccttcccctgtccggccagagaccccggcctgggaggatantttgagcccaggagttttgggntgtagtgcgctatgccgatcgggtgtccgcaataagttgggaata

SEQ ID NO: 55123 - DNA, 379 bp, Homo sapiens
ggaggctgaggcaggagaattgcttgaacctggaaggtggaggttgaagtgagctgagatcacaccactgcactccagcctgggtgacagagcaagactcggtctcaaaggaagtgaagatgttgttagaagggaaacaaactcaattatacaaacagtaaataatatattgttaaagggtgacaaccctgaataaatagctttttcttttctgcaatttcaccaactctcagttgactagaattagaaatataaaaacagaaatggcagaggaagtgaaagtgtggtccctttggagctagctttataatttccgaaagatccacctctgctttattatatggggcaatgaaaactctcagcagttcgcttcacaggg

SEQ ID NO: 55124 - DNA, 456 bp, Homo sapiens
acgtaatttgcccacctcggcctcccaaagtgctgggattacaggcgtgagccacatcaccggcccaatccaagtctttaaaacaaacctcagagacagctaatgggtttgctttgaagttcccagcagtgagaagatacttggttggtggtagagctatgcctttccgaagaaagtcttcaggaactccatttcactcctaggtgcgtgcttactctgaaatccagatacataaaaaagcactagctgggtgcagtggctcacctgtaaatccagcactttgggaggctaaggcaggaccaaagttcaagaccagcctgggcaacggagtgatacgctgtctctacaaaaaacatgaaaatcaggcatgatggcacttgcttgtagtcccagctacttgggaagctgaggtggaaggatttcttgagcctgggaggtcaaggttgcaataagccg

SEQ ID NO: 55125 - DNA, 603 bp, Homo sapiens
tctgccttaaccattattcctgttcttcttccccacaacagaagcgagacatccagctgctaaaggcatacatgcgtgcaatccgcagtgtcaaccccaaccttcagaacctggaggagacaattgaatacaacgagatcctagagtgagtgtcactcaggacgtggagtgatttcatgtcctgacaacaaggcctgaaaggaggaagagcaggagagtagcagaaggagggcattggagagctgggctgggggtcactgcttctcagatattggcattaaggacaggggcagaggagaagaggataacccttagctccactacaggatgtcttatgcgtttgggtggatggagggaaagcctgcccaaggatgcactttatccagaattaggtgagtacccatgtacaaagccctgtattaaaggctgtggagtgctaggagggccaaaaagaaatagaagatatcgtcctgtcttcaggtagcttacaacccagagaagaggaggcagagtgcaagtccaggaaagtgatctctaaaatgcagcaaaaacaagcgaagtatacaagtgaagtctaagatctctttcagttctggagtccta

SEQ ID NO: 55126 - DNA, 3304 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctcta

SEQ ID NO: 55127 - DNA, 4237 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaattcttcagcattactccctttcttgagaaggtttcccctctgcttttgcctttctctcaccttaattccctttcttccttactttgttacctacccttatcttagtgctaacttctctttcaggaggatgtctgggagtagtgtgcacttcacagctgctttcccatgtaccctcctgcattcttccctcctatctcctgttctgtagcagccaaagctctctagtgatctgaactgtgtacttcccagggtctgcctttatcctaaattccatgtcttccctgagtggtcctgagtttttgggataatttctacagaagatatgtatatatctttttcctttgtcccacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggcaggcacctgtagtcccagctacttaggaggctgaggcaggagaatggcgtgaacctgggaggcagagcttgcagtgagcagagattgggccactgcattccagcctgggcgacagagcgaggctccgtctaaaaaaaaaaagagaaaaaaagaatagtcttcataggccgggcacgggggctcacgtcgtgtaatcccagcactttgggaggccaaggtgggtggatcacaaggtcaggagatcgagaccatcctggctaacatggtgaaaccctgtctctacta

SEQ ID NO: 55128 - DNA, 3161 bp, Homo sapiens
agcgggcgtagcagcggtgggcggggcaaaggatccgtctgaggcggcgacgagtgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctcta

SEQ ID NO: 55129 - DNA, 3767 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaattcttcagcattactccctttcttgagaaggtttcccctctgcttttgcctttctctcaccttaattccctttcttccttactttgttacctacccttatcttagtgctaacttctctttcaggaggatgtctgggagtagtgtgcacttcacagctgctttcccatgtaccctcctgcattcttccctcctatctcctgttctgtagcagccaaagctctctagtgaacctgggaggcagagcttgcagtgagcagagattgggccactgcattccagcctgggcgacagagcgaggctccgtctaaaaaaaaaaagagaaaaaaagaatagtcttcataggccgggcacgggggctcacgtcgtgtaatcccagcactttgggaggccaaggtgggtggatcacaaggtcaggagatcgagaccatcctggctaacatggtgaaaccctgtctctacta

SEQ ID NO: 55130 - DNA, 3277 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgtcgggtacgcagcagtgtggtcttgtgcagcaagagtggcctg

SEQ ID NO: 55131 - DNA, 3447 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacagaccagcttttgatacagccatgcactctgcattttgatgtgaaagctgccaccttcaataggtcatttctctgccagccttgccagaccagagtcagttgtatcatcctggggcaagtatgaggagaagctcacgattaccaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctcta

SEQ ID NO: 55132 - DNA, 3960 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaaaaaaaaaaaaaaaaaaaaaaaaaaaaaaaaaaaaaaaaaaaaaaaaaaagaaaaaaaagcggggggggcgcagccacaaagaagtatccccgcaggggggggccccagaatatgcagagacgtacccacggacttttgtgtcacacgagggggcgccccaaagggagggccgtcaataaataaacacacagggcacaggggcggcggcatgtataaacaagatgctgggcgagaaggagcggagacaaaacgctggcgagaccgcgccggggggcaacacacaccgggggaggaaaagagcaccaccactaccaacgtcggcaggggggggggggagcacacaccaagagtcggggacacaacacaacgaacccgtccacagacgagaagactgatcactgaacgcacccctcgagcgcgggcgaacgaagccatatacacaccactcgatgaaggacgcgtgacacgcacgcagggcttacaaaccaccaccgagcgggccaacagatgaatgatctcgtaggccgacggcagctgagcaaagagaacgtcgtcgggcccccacgaggggcgccgatcatcattccgagctcggcaaacacacaaattttattacaccgcaggcgggagcaatcgtggtagtatacaaacaaaacgacgagcatgaaacgagaaagagtcagaacacgaaccagagacaacgcacagcaagcaactcatgaagaacacgagacgaaggaagaaaaaagagaggagagaaagaacaagaaaggaaaagaacacataataaaaatgaagagaacagagaaagaagcagagagagaagcgaagaaaagcaaagaagagaagagaaagacaagaaagaagaaaaaaaacaacgagaaagacaaaaaagaacagaaagaaacgaccacacaagaagaacaagcaaaacacaagcaaaaaaggagcacaagaacgaacacaaaggagaaaaacgaaggacagagaaagaagaacacgcaacaacgaaagaaacaggaaagagcagaagaaagagaagagacaacaacacaagagcagagcaaaagaacacagaaaagcaaaagacgggaaagaaaagaacacacaaggaagcagagacagcggagcgcgacgccagaccagacacgacacacaaaaacaaaaaggacaaaaaacgagagaggacagggagaacaccacgagcgaaca

SEQ ID NO: 55133 - DNA, 1893 bp, Homo sapiens
agtaggaagcttggacgaagaaagtgaagggaataaacaagagggaggcctgaaatgaatgttagaaattttgggtaggacaaaatctacttagcagttatctgccacagaataggccatttgcatacatgtcccagggatcacctctgttctgctctttccccaccctggtctgcagcctggagatgcccaaagatgagctgctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctcta

SEQ ID NO: 55134 - DNA, 1393 bp, Homo sapiens
  misc_feature (21)..(21): n is a, c, g, or t
  misc_feature (23)..(24): n is a, c, g, or t
cgctgggtcgatctagaggancnnacgtaatatgtaaccaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctcta

SEQ ID NO: 55135 - DNA, 2372 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttccttttttttttttttttttttttttttttttttttttttttttttttttttttttttttttttt

SEQ ID NO: 55136 - DNA, 1678 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctgggcttaaggaccttggggttcacgacgctcgatc

SEQ ID NO: 55137 - DNA, 1640 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctcatcaaaaaaagacaaaaaaaaaa

SEQ ID NO: 55138 - DNA, 1031 bp, Homo sapiens
agcgggcgtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtgggtgagatttgttcccttctgccccacatggataagggccatctcatttatgcccctgtctctggctgccctcctcactagctgaggaggtctctttggcatgttggcaaggagtattcttagcctccttggcttcctgctctaagatcttactttcttgctgcttttccaactataatcattttgctcttgctttaacaaaagaaggggcacagcaatttagtaaatttgtgtaataacattaaaggttgattgactctatt

SEQ ID NO: 55139 - DNA, 217 bp, Homo sapiens
aaaaaaaaacaaaaacaaataggaagtggggaactgtatgtactgacctatttttttcctgggatctactgaaaagaccagcttttgatacagccatgcactctgcattttgatgtgaaagctgccaccttcaataggtcatttctctgccagccttgccagaccagagtcagttgtatcatcctggggcaagtatgaggagaagctcacgattacc

SEQ ID NO: 55140 - DNA, 288 bp, Homo sapiens
gtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttt

SEQ ID NO: 55141 - DNA, 2950 bp, Homo sapiens
aagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggtccaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagaggaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaa

SEQ ID NO: 55142 - DNA, 832 bp, Homo sapiens
  misc_feature (194)..(194): n is a, c, g, or t
tctaaaccattcgattggggcccgtggcccatctcatgtcatgtagaggatgcgtacttaacttagttcccttcatgagtacctctcgtggttcacatgtatcctagcatgacattaggacattctctccacacacaatgataaacacagacgccggaagggacatcctgttgcagctgcatgacggcaacatntcctagtatctaggaggtcctagacggatcaataaagtgagatctctagtgcaatcatgtgaggtgcataagcagatgacacgactatcataaataactcacccgttaccctgctagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaa

SEQ ID NO: 55143 - DNA, 1720 bp, Homo sapiens
aatatgaactttcaaaaatagctgaaatgactacacagatgaagatctctgcaacaattggcatgtgagccagaattctgtaagctatgatgaaaagaaaggagactgttcttggactaaaagtttattaagtataaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagaggaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaa

SEQ ID NO: 55144 - DNA, 591 bp, Homo sapiens
ggcacactgtttgagcttcaggaaggcgaaagcctggcatagccgctgggtggagcaggagagaaagtcagcccggcctgaaggaatcgatggagtccaagggagcatagtggtacagggcctggggatggaggtgctgtgtccccagcttgagcaggagggtttttctactctgaacacggggtaggagtgggggaggtggtttgtagccctggtgtggggttggtgcctgggagaagcatgaggcactggggaggcacagggagctgatgaaaaagtggttctgatgaaaactatggtcagcaggaaacaggtaagagaccaagaggagaggggcttcagggcatctggggaggagtggagctccacagtacacgccaggagccttggtcctgtttcaggagtagcctgcctgagtgccaccatcaattacacatgtctggcttggttgtagatgtggcaagatagcaagaagtttcttggcttaaagaactctgtgaatgttggattcatggattgggtgttgactgctcttgggtcttgccacccccagaaagttttagcacgggtcacagagcagcgtcgggaggc

SEQ ID NO: 55145 - DNA, 625 bp, Homo sapiens
atgctgcagagtcagccccagcaatagtccaaaacagtgggactctttttgatgatttcaaaatggatagtttagttagccccaggccagataaattcactaagttgcctgtttggcaatggagggcagagttatcagcaaagtaggctgacccttctgtgggcagaatgaatattttgctaatgtttagaagaattccttttgtaagcatcaaagaagaactttaataaggattaagtgtctgagcttccttagcattattctattccaagacccaaaaaggaaaataacctccccaaatggtaaaaactgcttgtatatttagaattctctgatcaaagacctaatgaaaagattctatagtgtttgcgtcatcataagttaaatcttcatctaccacccaactgatacctgcctttctgtgagtgaaatcagaaacggctgttctttaataaatgctttcaatctgaaagtcagaaagtgatttatgaaacacccaggtgaggggagactacaagtccctttgccttttagttttcaagcaatactggttgcagtaactgctctgatgtaattattgctaacatttacgtttttattaaactgaaaatgctaactgtgaatg

SEQ ID NO: 55146 - DNA, 172 bp, Homo sapiens
caagagtaaaactccctctcaaaacaaacaaacaaaccaaaaaaacaaatagcaacagcaaccacaatcatcatcaccatcaaggctggaacaaggatgaggcaggcaggctctgatagcaacaggaggaagcagaccaaggagggagagaaaggaaggcagagaaggggaa

SEQ ID NO: 55147 - DNA, 340 bp, Homo sapiens
ttcagctcaactaggactttaaacatggaatggtccttatagaacccaaagcagccatttcctcaggtgtgtgtgtgtgtgtgtatgtgtgcgtgtgtgtgtgtgtgtgtgtgtgtgagagagagagagatgtctgtctgatcatagtacttgaattcatgatacatgaagtactacaattgactgcaaataacaacagcttaaaatttctttaactagtcttaacaccatgcaaaaaatgccctcacagcatgagccctcccggtgacagtacactaaagagctataagggaggatagagagagcctacacagggcatgatccgaatttggacaccagt

SEQ ID NO: 55148 - DNA, 420 bp, Homo sapiens
gaaaacaaggcagctgtggaggaatggaaagagaactagactgagagcaggagctcagatttccaggaccagctcatatgacggctttatgactacagccaccttgaagcatctctgaacatcagtgtcctcatctgtaaaatgaggtatttgattatgcgatctctaaggtcctttctaatgctaacacttcatgattctaagatgttatgaaatcatctgagtcactgtcaaactcaaaatcaagctttgccaaggagagccatttgtgaattgcaggatggccaattatcttgactggacaatataacagttcaaaagagagaacaacaaattataattcttttttttcttgtccaaggcaagatgattggttctgaaaatcacgcactgttcttagctcaaaatcccagacaagtt

SEQ ID NO: 55149 - DNA, 353 bp, Homo sapiens
cttgtttacaggttttgaaaggtttgttagattagtatttacttttaattttttgagtaatagaatgcgtttaggttctaaattactatggaaatggcatagtgaggattcttcacagatattagagaccttcaacaacatagtgaaaatagatttgttctttcttgtaaatagctgaactatgagaatttgatctgtcactggagggggcatttgctctgaagtttgccaaagtaaaaataactttgctctttagtaagaaaaagctatatttttcaatactggctgccacagcaaacaaacaaagtcttgtttgtgttttaatattggcaaaggaaaaattctctatataa

SEQ ID NO: 55150 - DNA, 387 bp, Homo sapiens
ctttgggaaggaattcagctcatggcttgattctgaaacaaaactgacaaagccttttcccaaaaagaccccctttttgccttgggaccagtctgcccttgcaagactaacaaattagctacaagattagaaattacagtttaggggtcatgcagcctctggctccaagagtctgaacctccctaaattcctcctggggataacatcagcattgtaaaacctaaggtcagtgcttgagatattttgtagaccctatgttggatggatcagctgacaccaaggagaccagtaatctggctcaaccagttctgccatcccacccaggaaaagacagcaagaaaacctcacttgaacccactatgattccatcttcaacctgaccagtca

SEQ ID NO: 55151 - DNA, 241 bp, Homo sapiens
tatcttgttgaatttggtttgctagtattttgctaacaatttttgcatcaatattcatcagggatattggcctgtagttttattttttaattatttttgaggtgtctttttttggttttggtttcagagtaataccagtcttgcagaatgcatttggaagtattccctcctcttctatattttgaaatagtttgagtagaattggtattagttcttctttaaatatttggtagaattcagc

SEQ ID NO: 55152 - DNA, 1438 bp, Homo sapiens
ctggaagaggcctcagcaggcccaggccacctggagggagagcagacctgcggctgaggatgcagggctcccgggcacggtgctagccctgccttgagacaccccgagagctgtgggaagagctgtgggatcccctattgcatcacaaagcggccctggagggctggtctttattttgatgaggctgagaagggaaggctgcgggcatgtttaatccgcatgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctcaaggagctggagcagctggcctccaaggacacccccatcaagatcacggctccccccgaccggtggttctccacctggattggagcctccatcgtcacctctctgagtagcttcaagcagatgtgggtcaccgccgcagacttcaaggagtttgggacctccgtggtgcagagaagatgcttctgaaggccgcttctcgttgggtaccgtggggggtgaaccctagccccagctttgggaggatgttcaataaaggaccaatgccggaaaaacctggccacctc

SEQ ID NO: 55153 - DNA, 1438 bp, Homo sapiens
tgctgctggccccggtatggatggccatgcactgtaggagagcagacctgcggctgaggatgcagggctcccgggcacggtgctagccctgccttgagacaccccgagagctgtgggaagagctgtgggatcccctattgcatcacaaagcggccctggagggctggtctttattttgatgaggctgagaagggaaggctgcgggcatgtttaatccgcatgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctcaaggagctggagcagctggcctccaaggacacccccatcaagatcacggctccccccgaccggtggttctccacctggattggagcctccatcgtcacctctctgagtagcttcaagcagatgtgggtcaccgccgcagacttcaaggagtttgggacctccgtggtgcagagaagatgcttctgaaggccgcttctcgttgggtaccgtggggggtgaaccctagccccagctttgggaggatgttcaataaaggaccaatgccggaaaaacctggccacctc

SEQ ID NO: 55154 - DNA, 1248 bp, Homo sapiens
atcagaactcttcggctctggattgaagccgacgccactgttcctggcaagcctcattgccctccgatcccggcgttggcctccgtccctgtcaggtcttgtacgatgctgctctctgccatcctgccgtctccagctctgcctgcatgttggtcctgcattgctctccacctcacagactcttattccacggctctggccagtccaaagcatacatggcccagttagttcccttttacttgaaatattccctgaggagcccccaggtatttttccttactcactggagacttgtagtcagggccacactgatgtcatttgggaattatttgcaaagtcacagatctggacttctctctccagctaaatcatgagttcctcagctaaatcacgggcccacagttctgcagcagctggtaaacacttttagtcacggaaggaagcctttttcggttctcagctctgcaaggaacttatttcacgtacacaaaaccacaaaccgtgagaggattgctgcctgtatcctgttcccctcatctttttttttctttgaaaagatggtaaagctgattataagaatttaaataacgtggccctagaactacactctgactctgatccgcgtgtcctgcccacagcaccaggccacgaagacagaccatgtcgctatcctcacatttgcttgtaacttaggaggcttgccagtaaaatcgatactaacagtggacgtacttctctttgaataagtttattctatttccttctcccattttctttatttgttgaaaagaatgatgctgattgagaagccaaatattgttaaccattttccccgtctggcacggttcttttgcacagcactggattaggccaggggactggcctaaccctgcaaatatcaggaaaggactcttctagggaaagtcgtactaatttgaattgatcactagaaatacatggtctccacctaaaagatgctttgtcacttaaaaggctgagtagtcatcataatgtaaagaaacctctattgtcatgcaaccatttgcacccagacattgtgcctggttggcacttaacattttatcacttgattctcacaccacccttgcaatgtgatgaaaccaaggctcctaggtgctaagtgacattcccctagtcacgcagcctagtgctagtcacgcagcctagtggtagagcgaggattcaaacccagtttttgttttcctttgagctggagctgcaagaaaa

SEQ ID NO: 55155 - DNA, 378 bp, Homo sapiens
gcattcatccaagttattggatccagtgcttcatttctctccagctggaatactgccatgaatcaacaggtctctcaaaacctgatcataacctgcttaacttccagcagtgaccataacttagaatttgttagtgccatctgcattggctggggtcagtattggccataactgcacttgagctcaactcatcaatgagacactttatgctgaaaatgtttcttctaaaattggtcttgctccactagcctcaggtttattccccagggaaaacaaaacattgttaaccaaaaatatttacctaatgtacaacttggtcttgacccatctttgtttattgtctgtcttgtctcaaaattaaagatcttagcttctgtc

SEQ ID NO: 55156 - DNA, 293 bp, Homo sapiens
tggaggacgctggggtgggccatctgggcctctcgtggacagaggttgactctaccacccagtgggcaacaagagaatccagtacctcccatgtgtggtgtgtgacctgccaccaagcacagcacattgcacacccgtgtcacatccaccgcacacaccagtcagagactccagtcctttttcgggtgtaagccatcatttgctgagcctgtgctccgggccaggcctgcactaagcactttgcatcccctctcttagtgagtcatcacagaaacccttagggtatgttatta

SEQ ID NO: 55157 - DNA, 286 bp, Homo sapiens
ccaacttcctgtggttacaaacagggttgaattatctaggaacatgggcaaacactggtctgtaaatctcctaagtggtaatgtgggaaccccctaagagtttagcagttgagctctttcttccaaacttctctttctctaggcggaacttcccaagctgccaatggcctccattggggcctggtcatttagagggaaaaatgacatcagcaacctaggtgctgacagctgacaaagttctttcaaatgcacaatgaaaccggcctttgcaatcatgccttagaaa

SEQ ID NO: 55158 - DNA, 217 bp, Homo sapiens
ctgatcctacacagctaacatgccttcaggggtcactgcataaagagacttaagtaagctccccaagtaacagcagctagtcccaggaaaagggaagacttaaaatattttgaaattgagtgagaaggtatcaggtgtctcataaatgaggagaaacttggtttgcttgacttccctgtgctgccctccctgcctctcccttttcatcaaatgtagt

SEQ ID NO: 55159 - DNA, 247 bp, Homo sapiens
atatgataaatgattatttcatctctgttttctgctccttatacattttaaaccgtattcatataaacatttatagtaccttgtttcagttctattttgaatagtcataatattgaagtcagttcactgttgtcttcagggaagtttgaagagaagtcacatacctagactgatgttttgcatgtttaaaaaaatcatctttctatttacatcatgcagcaattagcaagaacaagttttgcaagag

SEQ ID NO: 55160 - DNA, 270 bp, Homo sapiens
gacccatctgtgttaggtcccggaggctctggaatccctccacttctctctaccatcactcgcctcagctattctaatctcctaataatagatatccccttcaaataggttccctattcagagcccaagtgatctgttaaaaagggaacttgaatcctgtcatcccactgctcaaaggagttctagttttgtatgactctgaagacaaagatggaaatcagtactgtggccctcaaggccccaagggatctggtccctcttacctcctct

SEQ ID NO: 55161 - DNA, 933 bp, Homo sapiens
tcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctgtaagtagttccttaagaagaaggtggagtagaacaagctattgtacattttaaaaccatcagggagtttgatttgtctatcttcattcattctagctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgta

SEQ ID NO: 55162 - DNA, 3547 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagttggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggtttcgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55163 - DNA, 1532 bp, Homo sapiens
ggctcatgcctgtaatcccagcactttgggaggccgaggcgggtggatctcctgaggtcgggagttcgagaccagcctgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtacgatgacagaaaaatggacacgctctccatgagtttttgcagaaaatggtcctgtgtgttagaatgacagtataaatataatttcaagttcatgccattttctaatatagcaatgttagaagctagaggtctctgaatgcctctttcttgttaatactcaataacaaatattttatgcagattgtgtttctttgtttctctaccaaaaatatattggaaagaaaaaaggttttatgtaggaattgaaaatatacaccaaaaaccagttgtcattttcaaataacatagctttttgttgtgcttttaatagcaccgtgaaaatcttaagttttatcattaattgatgacaaataaaaatgcagtcttagcattggtattacttgtagaacaaaaccgttacaggaaagggacagattccagagttccctgatgcgtagagaacattgaaaacacaaagcatcatggaaatgggacacggcaaagagggaggggta

SEQ ID NO: 55164 - DNA, 2183 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttc

SEQ ID NO: 55165 - DNA, 3539 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagttggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggtttcgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55166 - DNA, 2408 bp, Homo sapiens
ggctcatgcctgtaatcccagcactttgggaggccgaggcgggtggatctcctgaggtcgggagttcgagaccagcctgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttc

SEQ ID NO: 55167 - DNA, 2966 bp, Homo sapiens
gctggaagagccaggaccgcatcacgttcgtggcatgctttggcaggacgcccctcttgttcttagatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagttggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggtttcgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55168 - DNA, 2791 bp, Homo sapiens
aaacatcagtccacacagggttcccgtgcatgggcctcgactacaatcatttccctgtccgatccttggctgttttctccacctgcagttgtaagtacttggatatgtgagaatttcctatgctttctaatgttatttttcaactttaaaagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagttggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggtttcgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55169 - DNA, 2545 bp, Homo sapiens
cgaaggccatggtaaccttctttttttattttcagcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagttggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggtttcgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55170 - DNA, 1307 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtacgatgacagaaaaatggacacgctctccatgagtttttgcagaaaatggtcctgtgtgttagaatgacagtataaatataatttcaagttcatgccattttctaatatagcaatgttagaagctagaggtctctgaatgcctctttcttgttaatactcaataacaaatattttatgcagattgtgtttctttgtttctctaccaaaaatatattggaaagaaaaaaggttttatgtaggaattgaaaatatacaccaaaaaccagttgtcattttcaaataacatagctttttgttgtgcttttaatagcaccgtgaaaatcttaagttttatcattaattgatgacaaataaaaatgcagtcttagcattggtattacttgtagaacaaaaccgttacaggaaagggacagattccagagttccctgatgcgtagagaacattgaaaacacaaagcatcatggaaatgggacacggcaaagagggaggggta

SEQ ID NO: 55171 - DNA, 571 bp, Homo sapiens
agctcggtacccagttcgacggagactctcaagaactgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagtctccgtcgaacttttttttttgagacagagttttgctcttgttgcccaggctggagggcaatggtgcccccgctccccacccttgaattatgcacatctcatggttttttttgctgctttttttttcaaaagcagctttactgagatataatttatattctataaaattcacctgtttcaagtatacaattcaatgactttgagtaaatgtacagcgttgtgtgaccatcgccacaatctaattttagaacattttcatcacagcaaaaatgatcccttgtacccattccggaattc

SEQ ID NO: 55172 - DNA, 530 bp, Homo sapiens
tgttgggaaactttaatttattacctggcagtttttctaaatagttccttcatactagtaattaagttatatctctatttcttaaggagcttagaacacgttgttactttagtaaaattcgatgtgtcttcaggaatgcaaaataggaggaaatggacttaaactgcatcagaaggaatctgggccaaatgcaaagaatttccccattatcatgagtgacatcaaaagcttgtttagcctgcttcccaagaaaaggaaagacctatctctctggaaggtttagcatagctctgtgtagaggtatggtgttgaagttcatgtccctggaaacagttttataagtgggcgaatctgctcatctaccatgcttcagtcgtgaatgagtcagcagcacagctgccgatggagtgggcagaagggcatctaaatttagtcgttattcacttgagaagattttcagggactatatgtctctcatccatgctttagtctctcatccatgctttagtcatattccttcttctggaggc

SEQ ID NO: 55173 - DNA, 623 bp, Homo sapiens
gcgcttttaactgcttgtggttgagtggcagcatgagcgagctctgcgtattccaacccggcgttaagaatccttcactagcttttcttcccgacgctgcttatttatctatcggtagcatgacgggtaattgacgccctcggatggctttgaggtcgccatttttggttggtgcctttgtcttggtgtcaggactgggatatcatctgggacacattaccccacaggtatcctgttggacctcaacgaggaagttggcaacagaggaaccaggagatgagagagatcgatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttgga

SEQ ID NO: 55174 - DNA, 693 bp, Homo sapiens
cactgcagcctgggcgacagagcgagactccgtctcaaaaaaaaaaaaattgtgttgataaagatctacttcagtcatctgaggtacagtatttcatttttcacattaatgctatgctgtaccttattctacaactcttttcactcgatttaaaaaaaaaaaattctaatactccttcgaagtgcagcatatagcatgccacaatatgaacacaccatgacaatcagcttatgcgtgaccttgtgaccttgtgcttccactgcacgcctgcctgggctgctccaaggtggtggctaggggtggcacaagttacacattttcaatttggataggttgtgattcttgtcttccccagtcagatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttgga

SEQ ID NO: 55175 - DNA, 628 bp, Homo sapiens
ctgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctcta

SEQ ID NO: 55176 - DNA, 698 bp, Homo sapiens
ctgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttg

SEQ ID NO: 55177 - DNA, 729 bp, Homo sapiens
tttccaggaaggcctagctcagctcacctctggaaaggtctccaagctgtgtgatctggggaatcgtggaggggttttgagctcaggtgtcttctgccagctggactctgagaccctggcctgctggggcgaggatgaggctctgatgtggtctggtcaactctgggttggccatctgcaccacagggctctaacaagggcctgctataggccatgagaaccactgtgtcaaggagcccatctccattttagaaagacagagatgcgttctgggccgttgcccgggaaagaatgtctaccaggacagttctgagaaggctcagcatcatatctaaacacaggaaaggaattccctgttggaaaattcaggatgacaactgtgggtagcaagccaaggcaaagggcagaacgtggagcagcatttgaggctccagccaattccagcctgtctgcaggcactgcctgcctccacggctgtcaggtgtcgcccccaggagctacgtagggcgaagctaggcaggctttcagtgccagctgtggtttccccaacagctcacaggccagaggccccgcccaggccacctcctccagtccccctgccgcggggtggtcttcggtggtctcactctccctcccactgcatttccatctctgctgtaatataccacctcagcccttcctttttgattcccaagagcaaattttggaaataaagcaacctgaaaacat

SEQ ID NO: 55178 - DNA, 159 bp, Homo sapiens
atagatatataaagcaaagagccacagaacttcatgaccaaggtcacccagctaataagcagagccagaatactatctctttccactctaccacagtgcctctataggccatgccacaccagcaactcttctgccgggccatcaccattctccgtattc

SEQ ID NO: 55179 - DNA, 352 bp, Homo sapiens
gtggtaaacaggatagaaaatgtctctgctctagtggatcttaattcaaattaggcaggagatgatggtaactttgatgtgagcattggaggcagaagagaggagaatggatgcaggatgcattttggagggagatctgatgaaatttgtgatggattagatgtgggtgataagagaaagctatggaaagaatgaaatcaaggatgagcaagtaggtgagtaatggtaatatttactgagatgaggaagactccatttctcccagcagccctttaagttgggttcacctatcccaccctattcctgtatctattttattctatatctatacatctaacctttatctatattg

SEQ ID NO: 55180 - DNA, 365 bp, Homo sapiens
tctgtagcagttggaattgaatttgtgcacaatctaaaactatagaaggagaaattacagttggccctctgtatctggattctgcatctgtggttggttgaatcgaaaatattgggagggaaaaatggatggttgtgtctatactgaacacaaagtctttttttcttgtcattccctaaacaatacagcttaacgactatttacgtagcatttacgtcgtattaggtattatgagtaatctagagatgatttaagtatactggagggtgtgtgtggattatatgcaaatcaccactttatgtaagagacttgagcatctgtagatttcgatatcctagaaccaatccccccacaggtggcaaagg

SEQ ID NO: 55181 - DNA, 483 bp, Homo sapiens
ctaatgttagggaatcctaagaaatattaaagaattgggaaaagaggaacctggaaggtagagtagtaaacaggaaagggaggaaaaacaggaggtggtaataaagtagtgttaatgaatccaagagggagcagtcaccatcttcaaatgtgatattgaaattagctgggatgtccagttgtttaatccattaaattgtggaaacagtctttctagtgcttaattataggaatcattgatcatattaataaactttcagttgaagcatcagcagataattattccaaaaccctctggcaaagaaatgtagatgcttttatagtctaccattgaacacagttttacgtgacacttggcaaaacttggagatggatggcactattttgtaagagaatatgaaacactgctttgaagttgtcattaaaggatcttatcaggtgctttttctcttgtattttgtttataaattttgtcctatctgtc

SEQ ID NO: 55182 - DNA, 446 bp, Homo sapiens
caacagccctctgggagggcaagtggaagagtgagtagatcagctggataggagtgaggagttggaggaagggttggggtatggccagtgcagttaagtgacttgccttagtgcacacccccagaaagtgacagcaccagcatttgaaccctgacacaagcatctccaaaactgcattcttcccactgtgccacagttaagatgagtccaccagccctgtttagactttggtgtttgaactgcgttttgaaggcaaagaagtcagatagacaaatgaaagagagggaaaaggcactccaggtagcaggaacagcatgtgcagaatcaaagaggcatgaagaaaacttaaaatgtagtcttccaagtcatgtaccctagaacttaaagtataataaaaaaataaacatagaaaaataaaataaaataaacttttaaaaaatgtaaaa

SEQ ID NO: 55183 - DNA, 616 bp, Homo sapiens
caacagccctctgggagggcaagtggaagagtgagtagatcagctggataggagtgaggagttggaggaagggttggggtatggccagtgcagttaagtgacttgccttagtgcacacccccagaaagtgacagcaccagcatttgaaccctgacacaagcatctccaaaactgcattcttcccactgtgccacagttaagatgagtccaccagccctgtttaggtgagttctggccctccctgtgtgtccccacatgcagccaactgcatccaacctgtccatgccaggtcctgtcctgagaacagtgggcagtgctgggcttggggcgtgtgcaggggggcgaggggagcccagtggaggctcagactgatttcacctggcatttcctcaagactttggtgtttgaactgcgttttgaaggcaaagaagtcagatagacaaatgaaagagagggaaaaggcactccaggtagcaggaacagcatgtgcagaatcaaagaggcatgaagaaaacttaaaatgtagtcttccaagtcatgtaccctagaacttaaagtataataaaaaaataaacatagaaaaataaaataaaataaacttttaaaaaatgtaaaa

SEQ ID NO: 55184 - DNA, 187 bp, Homo sapiens
cccatcattacctattcacactcaactctcttggcttaaaaagtaccagaaaaacaaaaacctgtagctatggtcttctctcctttccaacacacttcttgaaagcaatatcactcagtctctagttgttcacccctactgactaacccacctgctccggaaagggagactcgaatcccttgccttt

SEQ ID NO: 55185 - DNA, 127 bp, Homo sapiens
attgtgctgaggatttcctggaggacagcccctcccctccagccaacaagggctgcataggcaggggcacacagggagggacttctcccaggcagggagccagagggagagatgaaggggaggtgag

SEQ ID NO: 55186 - DNA, 2435 bp, Homo sapiens
ggcacgcgctctactcctgtaacggaaaggtcgcggcttgtgtgcctgcgggcagccgtgccgagaatgaaccccagcacccccagctacccaacggcctcgctctacgtgggggacctccaccccgacgtgactgaggcgatgctctacgagaagttcagcccggcagggcccatcctctccatccggatctgcagggacttgatcaccagcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaa

SEQ ID NO: 55187 - DNA, 2075 bp, Homo sapiens
ggcacgcgctctactcctgtaacggaaaggtcgcggcttgtgtgcctgcgggcagccgtgccgagaatgaaccccagcacccccagctacccaacggcctcgctctacgtgggggacctccaccccgacgtgactgaggcgatgctctacgagaagttcagcccggcagggcccatcctctccatccggatctgcagggacttgatcaccagcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatct

SEQ ID NO: 55188 - DNA, 175 bp, Homo sapiens
cctttccaaatctctgccaaccccaaggaaatcacaatacggtaaagcagaggaaaaagtcaagcttttcatttgctcaaggtcacccaaaaagcttaattagaaaaaaaaattaattcacagtaagataagaatatctaaagtgtatcattgtttctttaaaagaagagaaagg

SEQ ID NO: 55189 - DNA, 692 bp, Homo sapiens
ctccaaatgcttccctgggtaaaatactggcctctccagactttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagcaagttttagttccagaagccagatgcttgccactgccagctccctgaggtgggcgttctcaccagccccattccctgctgagcagccacgggcccatctcccagcccagggcaaggccacatttcctcagacctctgagagctctgaagtcagcctgtgtggctggggtggatacaggccagctgaagtggacagaggataccggtgaacaataaaaataacagatagctatggcagtcagtggaacacagctaaaccattctgcccggcggagtggctcagtcagagtgccagatgtgggtgattcataagcgtagtggccatcatgttgaattgttactattgtcactga

SEQ ID NO: 55190 - DNA, 917 bp, Homo sapiens
  misc_feature (1)..(2): n is a, c, g, or t
nnttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaa

SEQ ID NO: 55191 - DNA, 773 bp, Homo sapiens
tttttttttccagcaatccttagtttttattctttttccagaaggtaatacatactctttgtaaaaatattaaaagaatacaggagagtatcaagtaaaaaagtagaagtcccccctcattttacatctccaattccactctccagaggtaatcattgtttttgttttgttttttttcaaatggagtctcgctctgttgcacaggctggagtacagtggcttgatctcagctcactgcaacctgcgcctcccgggctcaagcaattctcccgcctcagcctcctaactagctgggactacaggtggccgaggcggaaggatctcttgagcccaggaggtcgagactgcaataagccaagattgcgtcattgcactccagcctgggcgacagagcgagaccccatctccaaaaaaaaaggcccaaaaaacaagaaataggctggcataaggacagcttaaaagacctcagggtggagccttgtggggaagcccagcgtgtcactattgcacagcacgttcacactgcagtccgggggtgcttcagcaagtaaggcacatgggaagcatggctaggactcaggggacccaggttctggccaggtctcttctctggataatcgttttccccggacaagagacctaacctccctgagcacagggttctcacccttgttgccttcctgggatgggataaggatcaagtgaaataagacatgaataaatggggctgggtgcaatggtgcacgcctgtagtaagagctacttgggagggt

SEQ ID NO: 55192 - DNA, 798 bp, Homo sapiens
tttttttttccagcaatccttagtttttattctttttccagaaggtaatacatactctttgtaaaaatattaaaagaatacaggagagtatcaagtaaaaaagtagaagtcccccctcattttacatctccaattccactctccagaggtaatcattgtttttgttttgttttttttcaaatggagtctcgctctgttgcacaggctggagtacagtggcttgatctcagctcactgtactcgtctgggcaacagagcaagactgtctcaaaaaaaaaaaaaaaagtttaacagatactgatcaacagcctctggaaacagttatagccccaaccacagtgcataactgccttgcaaacagcagttttgatgagaaacaaatgaaatctaaaaatatgccatccgcacatttggcatataatttttagggggttcgaaggccccctgacctgaagcccacacaggactcctggctaagaccccctttacaggaagaccctaacaggtcaatgaaaagctgtgattgcatctttttctccgaaacatcatctgaactcctcaggcaggagctactgtagtgtgggctgcctgtgactcacttgagtagcttagcccaggaggacagagacaggaaactgccacgcacagctctgtggttacgtgaacctgacaattttcttgtgtgtgtgtcctgcaggtgattgcaaataactaaccaaaagaagtccctgggactgtttcagacttggaaaggtcacagaaggaaaataatattatataaagtgacaactatgcaaa

SEQ ID NO: 55193 - DNA, 723 bp, Homo sapiens
tcttgatgagggttttattattattattaattcagaaatccatcctaacatccagggccctaagaaccagaaataggtcaggcgcaatggctcaagcctgtaacccctgcactttgggaggctaaggcaggctgatcgcttgagtccaggagttcaagaccagcctgagtaacatggcataactctgtctctactaaaaatacaaaaattaactgggagaggtggtgcacacctgtagtccaagctactcaggtggccgaggcggaaggatctcttgagcccaggaggtcgagactgcaataagccaagattgcgtcattgcactccagcctgggcgacagagcgagaccccatctccaaaaaaaaaggcccaaaaaacaagaaataggctggcataaggacagcttaaaagacctcagggtggagccttgtggggaagcccagcgtgtcactattgcacagcacgttcacactgcagtccgggggtgcttcagcaagtaaggcacatgggaagcatggctaggactcaggggacccaggttctggccaggtctcttctctggataatcgttttccccggacaagagacctaacctccctgagcacagggttctcacccttgttgccttcctgggatgggataaggatcaagtgaaataagacatgaataaatggggctgggtgcaatggtgcacgcctgtagtaagagctacttgggagggt

SEQ ID NO: 55194 - DNA, 760 bp, Homo sapiens
  misc_feature (1)..(2): n is a, c, g, or t
nnttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtgagttgaccacactgtacttctccccgtccctgccccactccctttacatctcccctttgcccttccaccatggcgtctattgtgctggcaaagtgagtattgatgggactcagagagcagcacaggcaactttagcaataagatatatttccggctgggcgcagtggctcatgcctgttatcccagcactgtgggaggctgtggtgggcagatcacctgaagtcaggagtttgagaccagcctggccaacatggtgaaacctgcctctactaataatacacaagtagccaggtgtggtggcacacgcctgtaatcccagcaactggggaggcttaggcaggaggatcgcttgaacccaggaggcagaggttgcagtgagctgaaattgcaccactgtactccagcctgggcaacaaagcaagactctgtctcaaaaaaaaaaacaacaaacaaaacaaaattttcgggggcgccgcgcccgaaaaactttctcaaaacattcgtgtgggccccgccccgcgggatgggacacacggccacagggccaaggaaccggctcaacagggtggttccccaaaaaacccggggccggcgtttaaaac

SEQ ID NO: 55195 - DNA, 757 bp, Homo sapiens
  misc_feature (1)..(2): n is a, c, g, or t
nnttacagaactcccacggacacaccatgataaggacgctgctgctgtccactttggtggctggaggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacgtctccctgcagtacagctccaatggccagtggtaccacacctgcggagggtccctgatagccaacagctgggtcctgacggctgcccactgcatcagctcctccaggatctaccgcgtgatgctgggccagcataacctctacgttgcagagtccggctcgctggccgtcagtgtctctaagattgtggtgcacaaggactggaactccaaccaggtctccaaagggaacgaattgcctgtcaaatggtaacccgtttccctcacaaataatacaaagccctcgtcttcacgcgggtctccaattacatcgactggatcaattcggtgattgaataataacaaagagtcctgggactgttcagacttggaagggtccagaggaatattataaggcacttgcattctt

SEQ ID NO: 55196 - DNA, 1174 bp, Homo sapiens
  misc_feature (1)..(2): n is a, c, g, or t
nnttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaaaaaaaaaacaccaccacgaccacaaccaaaacctgggtccggccgcgcggccccctcgaaaaaagtttgtaaaacccatctcgtgagggcgcgggggcccagtaggttagtggcccagtggcccaacagctgtcccagagaagacgggtcagacatcgggcgggatccccccataaaaaagccgcggtaaccgaggtttgacaaacccagagggagtcgagccacagggcctcaaccgggtccaggagacgattcaa

SEQ ID NO: 55197 - DNA, 1449 bp, Homo sapiens
  misc_feature (1)..(2): n is a, c, g, or t
nnttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcgcgcctcagttgtggggtctccacttacgcgcctgatatgtctaggatagcttggaggtgacagaagcgaggccctaacagtctgtgctcctggtcgaggtctccctgcagtacagctccaatggccagtggtaccacacctgcggagggtccctgatagccaacagctgggtcctgacggctgcccactgcatcagctcctccaggatctaccgcgtgatgctgggccagcataacctctacgttgcagagtccggctcgctggccgtcagtgtctctaagattgtggtgcacaaggactggaactccaaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacgtgagtaccaaaaatcaggggcc

SEQ ID NO: 55198 - DNA, 2164 bp, Homo sapiens
  misc_feature (1)..(2): n is a, c, g, or t
nnttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacgcaacgtgagtaccaaaatcaggggctccgctccatgacaaaatgtggctggggataaggctatagaggtccatccctccataggtccatcctcccacctcctggcagaattaccccgaaacatgttccagatatatctttggccaggcacggtggctcacacctgtaatcccagcactttgagaggccaggcgggcagaccacttgaggtcagcagttcaagaccagcctggccaacatggtgaaaccttgtgtctactaaaactaaaaaaattagccgggcatggtggcaggcgcctgtactcacagctactcgggaggctgaggcaggagaatcacttgaacccatgaggcggaggttgcagtgagctgagatcacaccgctgcaatccagcctgggtgacagagcgaaactcaaaaaaaaaaacaaaaaaacttgatcttggttcttttttgttcttgttttgagatgttttgagattctccttgtagtatccacccatctcactgctgggaagtccttccctgggtctcatcaaggtctctcgtgactgtcactatgtatcctttcctctatgctggaagggaaccaaaggaaagtattccctggcttagggcctttctacgatgacttctggtttttctgttgaattagtctcatcaatggcgcagcgtgtcccctccaggtagctgccacggaaaccttcctggagacagtgtcttaaccaccaggaactgctctgtgcttggacttagcagtgaagtggggatggagtaggaaagagttccacacgcccttcagatcacactgtgccctacacactctgcccacatagaccacccgcgggaagacggaaccagtggggaagagcctggcagctgaagtctgggatgtggcctcagctcctttacaaactgcctgtgcaaccttgggcaagtcccaacctctcaacactccagtttctcctcttccgtggcctggggatgctacgaatatttacctcataggattttgtgaggattaatgagatgaggcatagaacatgcttagctcagctctggccacacaggaagaataagtgttggctcttgttggaattatggtaccaccttgggctatgaccacaagggtcagcttccgaggacagtgacctgcagcagaacaatagaaatgcattgagaacaatggttccaatgggcagccccttcctctccctttacctgcctataactctggccttcctcagggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaa

SEQ ID NO: 55199 - DNA, 1369 bp, Homo sapiens
tgttataaggatttaaaagttttatcccaagggcagagatacagccaggcatcaggaacaagctagaatcaggggctggaaacctgtaagaaacacaggaaaccctccctcagaatttctgttctttgtgggtctacttcattctccacataaaacaaaatgtcagtcattgccaacagcttcccagaattatgtcctctgaaaccggaatctcatagaccccatctcagaatcccaggggagggagctcattggcttagcttgagtcaggtgttcactgctgaaccaatcaaccgtgaggacacagtatagacaaacgtggctgttcgcatgttgcaatggatggaagcaggaacaggggaaacctaagacgggtccatcacttcctttttctcaggagtccctgcatccctaatggcttctctctgatctcattcagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcgcgcctcagttgtggggtctccacttacgcgcctgatatgtctaggatagcttggaggtgacagaagcgaggccctaacagtctgtgctcctggtcgaggtctccctgcagtacagctccaatggccagtggtaccacacctgcggagggtccctgatagccaacagctgggtcctgacggctgcccactgcatcagctcctccaggatctaccgcgtgatgctgggccagcataacctctacgttgcagagtccggctcgctggccgtcagtgtctctaagattgtggtgcacaaggactggaactccaaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacgtgagtaccaaaaatcaggggcc

SEQ ID NO: 55200 - DNA, 2084 bp, Homo sapiens
tgttataaggatttaaaagttttatcccaagggcagagatacagccaggcatcaggaacaagctagaatcaggggctggaaacctgtaagaaacacaggaaaccctccctcagaatttctgttctttgtgggtctacttcattctccacataaaacaaaatgtcagtcattgccaacagcttcccagaattatgtcctctgaaaccggaatctcatagaccccatctcagaatcccaggggagggagctcattggcttagcttgagtcaggtgttcactgctgaaccaatcaaccgtgaggacacagtatagacaaacgtggctgttcgcatgttgcaatggatggaagcaggaacaggggaaacctaagacgggtccatcacttcctttttctcaggagtccctgcatccctaatggcttctctctgatctcattcagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacgcaacgtgagtaccaaaatcaggggctccgctccatgacaaaatgtggctggggataaggctatagaggtccatccctccataggtccatcctcccacctcctggcagaattaccccgaaacatgttccagatatatctttggccaggcacggtggctcacacctgtaatcccagcactttgagaggccaggcgggcagaccacttgaggtcagcagttcaagaccagcctggccaacatggtgaaaccttgtgtctactaaaactaaaaaaattagccgggcatggtggcaggcgcctgtactcacagctactcgggaggctgaggcaggagaatcacttgaacccatgaggcggaggttgcagtgagctgagatcacaccgctgcaatccagcctgggtgacagagcgaaactcaaaaaaaaaaacaaaaaaacttgatcttggttcttttttgttcttgttttgagatgttttgagattctccttgtagtatccacccatctcactgctgggaagtccttccctgggtctcatcaaggtctctcgtgactgtcactatgtatcctttcctctatgctggaagggaaccaaaggaaagtattccctggcttagggcctttctacgatgacttctggtttttctgttgaattagtctcatcaatggcgcagcgtgtcccctccaggtagctgccacggaaaccttcctggagacagtgtcttaaccaccaggaactgctctgtgcttggacttagcagtgaagtggggatggagtaggaaagagttccacacgcccttcagatcacactgtgccctacacactctgcccacatagaccacccgcgggaagacggaaccagtggggaagagcctggcagctgaagtctgggatgtggcctcagctcctttacaaactgcctgtgcaaccttgggcaagtcccaacctctcaacactccagtttctcctcttccgtggcctggggatgctacgaatatttacctcataggattttgtgaggattaatgagatgaggcatagaacatgcttagctcagctctggccacacaggaagaataagtgttggctcttgttggaattatggtaccaccttgggctatgaccacaagggtcagcttccgaggacagtgacctgcagcagaacaatagaaatgcattgagaacaatggttccaatgggcagccccttcctctccctttacctgcctataactctggccttcctcagggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaa

SEQ ID NO: 55201 - DNA, 510 bp, Homo sapiens
agctttcatgtttcctatttttcactcttacattgtgcaatgaacatccttggacataattcttgcacacttgagtatttgtgctgtagcagctggatatcctgccgtttacagcactggatcatgaagttggcatatcaaaatgtttaacaggctgggcgcggtggctcacgcctgtaatccgagcactttgggaagccgagacgggtagatcacttgaggtcagcagttcgagaccagcctggccaacatggtgaaaccctgtctctactaaaaatgcaaaaaaatcagccaggcatggtggtgcacacctgtaatatcagctactcgggaggctaaggcaggagaatcgcttgaacctgggaggcagaggttgcagtgagcctagaatatgccacctgtactcgtctgggcaacagagcaagactgtctcaaaaaaaaaaaaaaaagtttaacagatactgatcaacagcctctggaaacagttatagccccaaccacagtgcataa

SEQ ID NO: 55202 - DNA, 194 bp, Homo sapiens
ttgaaagatattattaaataaatgaaaagataaaaaaacttggaaaaaatacttgcaaaatgcctatgtgataaagctttgtatccaaaatatataaagagcatttgcaactcagtaaaaagaaaacaatccaacagaaaatgatcaaaagatctgaagaggtacttcagcttttattaatgatgactgaaatt

SEQ ID NO: 55203 - DNA, 340 bp, Homo sapiens
gaaccctggaaggtctaggctacagtgagccatgtttgcaccactgcaccccagcctgggtgacagagtgagacactgtctccaaaaataatagtgataataataatagtcatttattttaagtctacatgctgagatgccagaacaagtaaaattggattatagattcaagcagtatgtaggtatactttcataaactgaatactgatgtaattttggatgattaaaaacagacttttagtaggtgttcaaaaatctggataattcctttcatgacattcaaacatttaggtggcctgtctttgtttttttaggatataactgcaaacattcaattgtt

SEQ ID NO: 55204 - DNA, 355 bp, Homo sapiens
tcgtgagtttgtaaaacattttgttttaaaagagtttctgtatgattagtcctgatggttaaaccatagctttgaataatgaagtatataaagcatgaaaagttagaggtggatataacaaatatatctaccatctgggttaactgtctagttgaaagttcttgtactccccctttcttccatccctcatccattcctttaggtaactactatcctgaagttgagaatattcttcctgtgtgttttgacacacccacacctatatacatttatacacacacacagacagaggaggccatacagacccgtaagttgaacagttttgcctagctgctttcataggtaaacacaaatt

SEQ ID NO: 55205 - DNA, 345 bp, Homo sapiens
aaatgtggctgcctaataacctgtgcaagttttaaaactcagaatttcaaactgcaaatattttagaagatatttattttttcacttagtttcaatctggatgcccagatgaagagaatggaaactctaattgttactattttgaaaagatccagcctacccttgtcaattactgaatagacctttcacaggactggaaaagtgttttgggctccacctgctggacccacggagcttttgtgttcagtatgtgactgtactttagaaaacaaattaaatcagtggaattgggaacaaattgtccttctcaacagggctggtagacaaagacatgtaaaaatgaat

SEQ ID NO: 55206 - DNA, 284 bp, Homo sapiens
cagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatgg

SEQ ID NO: 55207 - DNA, 249 bp, Homo sapiens
gtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtat

SEQ ID NO: 55208 - DNA, 809 bp, Homo sapiens
ggagaccaggctgcacagaccgtcacgtccattccctctctggccccagccccgcgggaagaaaacgagggcgttcagcctggcagttcattcacttattaggaagaagacatcccacacccccacccagcacacacacagatgtcagggaccagccactaggaaccactccctgagcgaatgaaggcatccccgtagccacgtgcctggtacatcacaagcactcaaaacgtggctgccacctttcgaaattgcatgcccaaaactttatgagatcctcacaacacacttgggaaacagacaaaagagtttgaatgcccgcctacttaacagatacagaaaatggtgttccgtgtacaagcgacttactcatgtctgctggtaactcataatgtgccgtttgacctccttaggacataattaataatggtaattaacagtgctacgatatgccaggcattgagcttagcgccttaaaagtcatagctaactatgtttcacagcaaaccctcagaggcaaatgtgacccgcctcctacgcaggaggcaacagaggctcagacatgttaaagaagcttggcctgagtctcccagcagagaaagggcagagcgtgtagccctgacaacgtgcttaattgcaactcctgtgggtcccatcacaactctctcttcctatgtggtgtccgcaacattaatacatagagacaccgaggagcctcagttctgcttgtgggcgggcctgtctttcaccaggctggcaaaagcagtgcaaacatcattttggaggtgataaaataaaatctctcacag

SEQ ID NO: 55209 - DNA, 653 bp, Homo sapiens
ctgttcatcgctgagccagtaaagatactgcactccagctgcataaacataatataacccagtgggaaaagatcaagtatgccattacagaagggtttatatggtttcagccagaccctgaagttgaaggatgcagtagagttttaggaagacgagatgaagtgtagaatatttcaggcagagaagaacatagtgtggacacaaagggatgaaatttggacttcaagtgtcaggagtggaacttggagttcaagtgtcagaagatttggttacagatgtttggtaaaattgtagtgccagaaaggtggggttggtgctttgaatgcttggtaaaaaaaattaggaagtcattaaaggatgttttaaaaataaggaggccgggcgtggtggctcacacttgtaatcccattactttgggaggctgaggcaggcacatcacctgaggtcaggagcgtgagaccatcatggtcaacatggtgaaaccctgcctctactaaaaaaaaatacaaagaactagccaggcgtggtggtatgcgcctgtaatcccagctattcaggaggctgaggcaggaggattgcatgaacccagaagctggaggttgcagtgagccgagattgtgccattgcattccagcctgggcaacaagagcaaa

SEQ ID NO: 55210 - DNA, 511 bp, Homo sapiens
aatctctcattccagcccaacctatttaactttttgtggaggaattttacatggaggaagtgagcacatgtcatgctagccaagaggacattattgtcattaaagagaggcattatttatacaccctgcaatgtgcacattaaaatatggaaattttaaaattatgaccaagggcttgaaacatattggattacatgctcacatttaacaaagagaggaaatgtgtttcagtttctggagtggctggaatttacaagctaattgttcaataaatctactcaagatagttacctaaggctttgtggcaatgaccttgaactgagagcctgtatctggatttagcacttgaaagatctaactggatatttgggttaaaagaatcacatttattcccaaatcggaatgctttgtttttcctgtcagttaattgccagttgccaacaaatctagttctatacagtttcttgggatgatgataataaacatttattgagcaattgtcccataactt

SEQ ID NO: 55211 - DNA, 429 bp, Homo sapiens
ccccctaaatatgcagatttttaaaaaaccacgttggggctcataaagtaacattgcatttgcacattttctaacattaagctttgtatggcttaaatctctgtaggaatgggctttcctcgttcccttggaggagactgcgtgggtttctagactatactaaggttggtgagttgatatgcagtaagcatgaagtcagttactcccgacgccagggcctggggccaaggaaggggctgtgttctggatactccccactctcaccgcctgtcccgggggaatgcccttgtctcgttttttgttttgttttgtttgtttgttttgagacagagtctcacattgtcatgcaggctggagtgcagtggtgtgatctcggctcactgcaagctccgcctccctggttcaagcgattctcctgcctcagcctct

SEQ ID NO: 55212 - DNA, 442 bp, Homo sapiens
gatctctgactttaaggcaagtcaatctcaaaacaatctggataccttaaaaatcaggggggaatcgttgagaggccaaggtaggcagatcacttaaggtcagaagtttgagaccccagcctggccaacatggcaaaatcccgtctctacaaaaatacaaaaattagccaggcatggtggcgcacacctgtaatcccacatatcaggaggctgagttgggagaaacccttgaccctgggaggcagaggtcgcagccagcctgggtgacagagtgagactctgaatctaaaaaaaaaaaacaagggaaaaaaaaatgggggggatccttttttttttgcaccccgtgttacattcacactgtatctacttgcaaagaaaaaaggggtagggagttccaagtcatgggagtcagagacccagagaaatcagatagcctaggaag

SEQ ID NO: 55213 - DNA, 377 bp, Homo sapiens
aaaatagagttgtttacaagatttaaagtttccaaaatatgaaaaactaagcagtattccaaagaagcacagtgtttccagattctgagatatgagcaaaatttctcctccaggctctagtaaagaggacaatgttcttgttagcattctgaccctagattataaaagtttgttcttaaattgccctctaatgtttaatgaaacaatgctgcttaaatttggatttatctgttacccagtgaactgctcagctaaaaattattccataaacagcgtttcttcttgtctggcttctgacaagttttgaactgcaaagagtttagggttgtagtctctggtaaggatctgtaatgccagagttctatgtactaattaag

SEQ ID NO: 55214 - DNA, 447 bp, Homo sapiens
tcctggactcaagcgatcttcccacctcagtctcccgtgtagctgagagtacaggcctgcatggcaattcagggctaatttatttttttttggacgtggggtctcgctatgttgcccaggctggtcgcaaattcctgtcctcaagcagtccccccacctcggtctgccaaagtgctgggattacaggtgcgagccaccctgcctggcctatacatgttttcaagtgctgatcatttattaatagtgaagtgattgtagtcaggcgtggctcccccatttactggcaggtcccatttagacctgcggttgcagaagtacagcacagctctgtgcatgattggtggaaatattccaggagatgaggctgttacagtaacagcagatttttccattgtgaaaatgtaactattcctgctttgttgaagagaaagatttttttggaaaatg

SEQ ID NO: 55215 - DNA, 206 bp, Homo sapiens
tcggggagcctcctcagccagaggaggtgacaacaaagcagtggcggcggtggctccccaacatccgcagtttctattctttatagcagtgtaagaatggactaatacagtactgttaatatttccggatcctctcatttataaggccctgaatactctgcaactaggatttgaaactacagttctgggccccttagaacctctcg

SEQ ID NO: 55216 - DNA, 395 bp, Homo sapiens
ttgtccattgtccatccatccatccattcactcatccattcatccatttatccatccatccatctatgcatccatccatccatccacccatccatccatccatccatccatccgcctgcccatccattcatccatttatctacccatccacctactcattcattcatctatccatccacccacccgcccatttattcacccactcatccacccatcatctcttgaatctcttcggcatgctaaggactgccctgggtattggagagacagaaatgaaaggcattattcttgccttcaaggaactcacagtctagtgggctgtcagaaaactaagcaaatgattccagtccagagtgttaggtgcccagagggacaagtggccagctgtctgtccc

SEQ ID NO: 55217 - DNA, 267 bp, Homo sapiens
cataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagca

SEQ ID NO: 55218 - DNA, 409 bp, Homo sapiens
agaaagtttcctgttcctataatgtacaatgaataatcagctgcaatttcagtggatgtcagctgggctagatgatgctggagtttctgggacaaaagatgcacttcctaagttattttcatgcatgtaatgaaaaaattagaagacagcagaattgggtttaataaactttcctatttttaattgccactgaatgatgttttaaggacaataagtccttagaggaaagaaaaggctttaaaagcacccacttcttctcttccattgaaatgacatgtttcacctatgtgatgacttaattgcctaagagcaaggaacagtggaactacagataaccttagttgggctttagagcagggaatggatttctacctatatggcaattatataccatgttctctgagggtta

SEQ ID NO: 55219 - DNA, 796 bp, Homo sapiens
gggcacgagggtgcaaccttcaagacctcagggaagcctgggcttggtgctgccatcagtggggagctatagagtgtgcttgagctctagagggctgtagtgaaaaggaagttttctctgtgggggtgcggatcattaaacatgtcctcctctgacctgccagagctctgttgtctccagccacatgccgctcccccacagccaacatcatttctcctgcccctctaactgatcctccccagccagacaagcccggctcaaagtccccaacgctccatctccaagaaaccccccggggaaaatccctctggctctcaagacccgtggagcctgttgctggggaaggggagtaggaggaaggaagataggggtggcagaccctggcttcttccgcctaaagctttccattgctgagacagctgaggcccaagtgcagcctatgaggggaaagggatggaggtggggggtctttgaggagccaggcagacaggtctacccactgtcactctcgtccccaaaccacctcccagccctcccaaccctggtctctttgtttctgtgtctttgttttttgtttttagagacagagcctcgctcttattgcccaggctggagtacagtggcgcaatcacagctcctggcagcctgaaacttctgggctcaagaaatcctcctgattcagctcccagctacacaggaggctgaggtgggaggatcccttgagcccaggttgcagtgagccaagatcgagccactgcactccagcctgggtggcagagcaaaaccctgtatcaag

SEQ ID NO: 55220 - DNA, 479 bp, Homo sapiens
gggcacgagggtgcaaccttcaagacctcagggaagcctgggcttggtgctgccatcagtggggagctatagagtgtgcttgagctctagagggctgtagtgaaaaggaagttttctctgtgggggtgcggatcattaaacatgtcctcctctgacctgccagagctctgttgtctccagccacatgccgctcccccacagccaacatcatttctcctgcccctctaactgatcctccccagccagacaagcccggctcaaagtccccaacgctccatctccaagaaaccccccggggaaaatccctctggctctcaagacccgtggagcctgttgctggggaaggggagtaggaggaaggaagataggggtgttacactttttcttttttttcttgagttttaaattgttggtcatatggtgtcacatgaaaacaatttgtggtaaactttgttcttatattattcattctaaataat

SEQ ID NO: 55221 - DNA, 432 bp, Homo sapiens
gaacgcgtgccgcgcggccctcacggtgcttaggctgggtgcaacctagaacggaggttcctttcgtaccgtacatccaggtttgcacagcgcgcttatgtccctcctccaatctgatcttgcaccagctctgcagtagtttttcttattatcctcattttacggaggagagggagctgtggcttagagaagttaagagacgtgtccaaattcatacaacctgttgggcacctctttatcccgaacgctgttctaggggatagggttagtgaacaaaaaacgcaaaagcccctgaccgcctgggccttacatctattaggaggaggaagacagataaactaaggctcgtgcaaaggagaaaaataaagcaaggtgactttctgcagacttcggactcaccagtggtgtttcattctatttaatgtcatccta

SEQ ID NO: 55222 - DNA, 369 bp, Homo sapiens
ccaagacaagtgccttgtatatagtaaataagcttttatccaaacaagcaagaaaacaaccaactaacactttactcagtgttcactttgtgccaaatactggaatcagcagcactggagaagacagagacacgatgcctgctgtccaggagaccataatctagtggaagaaatagataatatatcacaataaacacttaaaatagagtgtactgctaaatgctgtgagaggtccgtatagggttcaatgagggcaaaaacaggaatagaggtgaagcctgaatgaacacgtgtcctttccttttttaggtgactttctgcagacttcggactcaccagtggtgtttcattctatttaatgtcatccta

SEQ ID NO: 55223 - DNA, 321 bp, Homo sapiens
cctaccttgaggagtatagcttgcgtgcgagtgggtgtggacctgtgtgcacactcggggtgtatatgaaacccacatctactggtctctgcccatgcagacccctcatgggagcggtatttatgtgaatgatttaccctggtgacttcaagaccacagaactccatccaacaaaggagctcatttactttctgacatggttaatgtcctgatttaatggccctcttatatcacactcagcaccctaaattatagggcaacccagacaataacactgcagggtttcaggctgtacctctccccagagctgccctcccatac

SEQ ID NO: 55224 - DNA, 462 bp, Homo sapiens
aagcaaaattccttgtttctcggagaatctcagtcttttctcctaagaccttcaaataattgattgttggaggcccacttacattatggatggtagtttgctttactcaatgtagatttaaatctactgatttaatttcttatcacatctgacatataccttcacggcaacatctagatggatgtttgaccgaacagctgggcaccatagcctagccaagttgacacatgaggttaaccatcacagttgtgaaaatatagttgacctttgaagaaaacaggtttgagctgcgtgggtccccttacgtgtggattttcttccacctctgctacccctaagacagcaagacgaactcttctacttcctcctcaacatgaaagcaaggaagataaagacttttgatgatccacttccacttaatgaatagtaaatatattttctcttccttatgattttcttaat

SEQ ID NO: 55225 - DNA, 1859 bp, Homo sapiens
aaaataatttctaggttaagttggaaacatgtgataacattaaaaaatttaaaatgtctttgggcctgaaagattatgcctttacattcaacatgaaatccatggatggagtttatataaataaccatgtaggcttaccaatccttaaccctcttgtattagtccatactcacatggatatttccatatccacttttactcttgtgtcaaaagacaaaattaaaactcatttagttatgtatctaattggcttttattctcgattcatgaatcggtgcagcctccattctaatagaatcacagcttctactgggcaatggcagactattgggttttgtgaggtgggaatgaggaaacataacaatggggaaaataagctgattagttaacaatagattacttcagtttactttttttttataagggttaaagcagaggggactttcttgttctgactcaggtaggctagaatctcctgtttttaggaaaaactcgtctgttttgggatctatctgctttcttacagttgcagtttgattatatgacatttggcatgagtgactccactttgttaacacttgaaaggttattattcccatatggagtattcacatggatgtagccattgtcagttatacaagatcgtgtttcttttctttgcccccctgcccccgtcacctaagaacttgttagatattccatttctttttttaaaaaaagatacagtgagtaaaggtgatagagagcatatggataaatagtgaagaagcttgatgaggggagtggttaggttagaaacacaagggaatttactcaggttaaaacactgtcattttatattcaagccaatatatatttgttttgttagcgttgacgtaatttttttctgggaaggctttcctgacctctggtttgagtaagcagctcctcctatgtgttttagtcagcactcttggcttaatccatagtaacttttgcttgtttgcattgtagttggttatatctgtctcctatagcttgtgggctcactttgacggggagaggccttgttctattcatcattaatcctcagggtctagcacctagtaaatactcagtaaatatttattaaatgtaattgctttatctgatttcttattgatattttttggagcagcagtgttgcgggaggtcatgttaatttaatcaaagtaaaaagaatttgggggttagtactggaaggtggttgggaagtgtatatatatatatttccaaactctttagattttcaaactttgttctcctgaggactttgccacttccagaactgtttcaggagctgctgtgggagaaggaggtcagtgcacgtccactgatgtggtttgaatgtgttctccaaagtttgtgtgttagaaacttaatccctggtgcaatagtgttgggagttggggcctattaggtgattcggtcatgacgggtctgcccctgtgaatggattactgtctttatttgggagtgggttagttataaaggagtgtgcaccgtctcttgctcttctgccctctgacctgggatgatgtaaaatgaagtcccttatcagatgcagacctcatggtcttgtacttctcagccagaactataagaaatacgtttattttcttcataaattaccgagtctcagatattctgttatagcagcataaaataaattaagacatctactttgcccatttatactggaggctttagccagaattctgtttataaagtttgcaggccaggcacggtggctcacgcctataatctcagcacattgggaggctgaggcaggaggatcacttgaacccaggggtttgagaccctgtctctacaaaaaaaaa

SEQ ID NO: 55226 - DNA, 386 bp, Homo sapiens
atcacctgagggtcaggagtttgagactggtctgaccaatatggtgaaaccccgtgtctactaaaaatacataaattagccgggcatggtggcatgtgcctgtagtcccagctactcgggaggctgagacaggagaattgcttgaacccaggaggcccaggttgcagtgagccgagatcatgccactgcactccagcctgggcaacagagtgagaccctgcctcaaaaaagaaaaaaaagtaaaaattaaataaaattaaaagtgctgtctcattgcctttgccttctcattgtaatggtcactgacaagaaggccgctgttatttatatctttggtcctctgtgtatgttatttgcctttttttcccccttcaggcactttcaag

SEQ ID NO: 55227 - DNA, 292 bp, Homo sapiens
catttatgagagcaaatgtctgtccctgcgcaatttctgtggggatagttgcagtcaggtctacaggatttgcttaaaaatttccaagacctgggtgtgtctgacagcctggacctcaacctcaaaaaggaactagctcctctctgatttccttgggacacctgggagcaagcacaggagcccatggagccacggagagtgtcacttcaagcgcctcctgggagctcttgcagatgccaagtgctctgcccttccccattacctgtgatttcaagtgggcttagagattctc

SEQ ID NO: 55228 - DNA, 345 bp, Homo sapiens
aaatggaactaacttataactattttctgagtgacgattgttacagagcatgaattaaaataatggtagagcaacatttttaggtgaaacttacaatagtgtattaaatctatgtagataacaattttggttttagtttaaaatctgcactatcctttatttttattttagtattattactattttttagagacagagtcttgctcttttttaaaaaagaaagaaaaaccctttcaatcttcaattactctttaaaagcccacttcttagctactgggccaatccacacccaattatttaaaattccactttgggtacacaccctgttgttcccacctgggggta

SEQ ID NO: 55229 - DNA, 1108 bp, Homo sapiens
gcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagccgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtcgtcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaa

SEQ ID NO: 55230 - DNA, 716 bp, Homo sapiens
  misc_feature (32)..(33): n is a, c, g, or t
cggacgcgtgggtcgacccacgcgtccggcgnnggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55231 - DNA, 1059 bp, Homo sapiens
  misc_feature (18)..(18): n is a, c, g, or t
  misc_feature (818)..(818): n is a, c, g, or t
  misc_feature (821)..(821): n is a, c, g, or t
  misc_feature (1058)..(1058): n is a, c, g, or t
ataggctagtacgaggcnggtgtaaattcggccgagggtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtggagtgttggtgcccacaatgtggcacgtggagacgnggngtgtcccaaatctgcggcgggaggtccgggttgtggcttggagggacgcatcaggccatatccatttctgggctgtacacctgctgtgggggttttggccttcaatgttggcagtgcgggttcgggggcaccctgtgatccgggcttaccttccactgttacggtgtctgcgggacagcgctggttggcgttgacgtttagcgtctcggtggtggctcctgtggttgtgtgctctcng

SEQ ID NO: 55232 - DNA, 863 bp, Homo sapiens
  misc_feature (18)..(18): n is a, c, g, or t
ataggctagtacgaggcnggtgtaaattcggccgaggggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccaaaaaaaaaaaaaaaaaaaaaacaaaaaaaatcgggcgttttttggggcggaaaaggggttaggggggggttttgtttttctgcccccctttttggacagggggaacggcggcccaagggaggtttatgaacgggactttggag

SEQ ID NO: 55233 - DNA, 518 bp, Homo sapiens
gcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccaaagtgctgggattataggcataagccggcgcacccagcccttatttctaatatact

SEQ ID NO: 55234 - DNA, 197 bp, Homo sapiens
cgagcttttaccagtgttgctgtggctgtgctaggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55235 - DNA, 1625 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55236 - DNA, 1582 bp, Homo sapiens
ggctggtactggtcgccaagccctgtagatctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55237 - DNA, 1546 bp, Homo sapiens
tcggtaggtacgaggctgggtggtgcaggtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55238 - DNA, 1573 bp, Homo sapiens
ccaccccgccagaccaccccccaccctacggctagtacgaggctggtgttatcaggtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55239 - DNA, 1546 bp, Homo sapiens
  misc_feature (27)..(27): n is a, c, g, or t
aagcaggctgtaccgtctggggtttanggtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55240 - DNA, 2239 bp, Homo sapiens
  misc_feature (1934)..(1934): n is a, c, g, or t
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccaaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctcctagacagcaccaagaaaactcatttggctcgctgaaggatgaagaccggattttcaccaacctgtacggccgccatgactggaggtgagacagtgcccttagtgtgttgggtcccggagcaaggtgtccccttcattgccttncctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccat

SEQ ID NO: 55241 - DNA, 1820 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggtaaggcctggggccagccaggtggtgggggggtgcgcagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55242 - DNA, 1527 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgactgtggctactggccttgtcaaagtctgatccgcccttttcggccgaactcaatgaacggtgcatcggttggccacaacatctgcccg

SEQ ID NO: 55243 - DNA, 1543 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55244 - DNA, 1555 bp, Homo sapiens
ggctggtactggtcgccaagccctgtagatctagcgtctctatcgcgccagttcctcagcctcagtgctatgaaggtgacagcgtgaggtgacccatctggcccgccgcgatgctggcaacacggcggctgctcggctggtcgcttcccgcgcggacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55245 - DNA, 1433 bp, Homo sapiens
  misc_feature (32)..(33): n is a, c, g, or t
cggacgcgtgggtcgacccacgcgtccggcgnnacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55246 - DNA, 1542 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55247 - DNA, 1377 bp, Homo sapiens
gcatcgcacgtcacgctgcggttcggatttcagcaaactgtacggtcggtatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55248 - DNA, 1571 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55249 - DNA, 1488 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55250 - DNA, 1426 bp, Homo sapiens
tttagcaagagagcggaataattatgaatataaacaattcctatttggagaaaatacattatgttcattgcttggaactatgaataatacttatatctgtaggaaatatagaaaaataaaataggttaaggcaataaggatataggcaattacatttttattttaattttataaagacttttatttttcctttacagactagggtagttaggagacctgatagtagctacttcgtttttattttcctggcagcaaagcagcttacttatgtgttccttcttgcttatctgttccagatcatagtcaagttttccaattcgttttactaagctagcaaaattttttataccaggagcattaggagcttcaccgtgggaggccttcaagggcttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55251 - DNA, 1076 bp, Homo sapiens
  misc_feature (913)..(913): n is a, c, g, or t
  misc_feature (917)..(917): n is a, c, g, or t
  misc_feature (922)..(922): n is a, c, g, or t
  misc_feature (928)..(928): n is a, c, g, or t
  misc_feature (932)..(932): n is a, c, g, or t
  misc_feature (939)..(939): n is a, c, g, or t
  misc_feature (1076)..(1076): n is a, c, g, or t
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtggagtgtttggtggcccacactgtggcaacgtggagaccgtggcgtgtccccattgcccggnggcngttgnggttgnggangctcggncatttcttttgccgtggccatgtcgggggggggtttgcccccaagttcatcgcgggcgggggcacctctttccgctccccactctgggagtctcgccggcctccctcttctctcgccagtctgcgcggctctcgcgn

SEQ ID NO: 55252 - DNA, 772 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacgctggtgattccgagatc

SEQ ID NO: 55253 - DNA, 972 bp, Homo sapiens
gcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagccgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtcgtcacgcctgtaatcccactatccagaggctgaggcacaagaattatttgaacctgggaggtggagtttgcagtgagctgagattacgccactgcactccagcctaggcaaaagagcaagagtctgtctcaaaaaaa

SEQ ID NO: 55254 - DNA, 1115 bp, Homo sapiens
ggctggtactggtcgccaagccctgtagatctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagccgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtcgtcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaa

SEQ ID NO: 55255 - DNA, 244 bp, Homo sapiens
aaggctgctctgaggagaataccccggagtctgggcagcacagggggcccagggaggctggaggaggccagaacgctgggtgggctgggaagagcttctggaactgggggaggggctgctgctagggggctgaggcccaggcttctgtctggccgtgggtgcctgctaattgcccctcgtcacccagacggacatcgtgaaagccatcgcccgcctcattgagttctataagcacgagagctgt

SEQ ID NO: 55256 - DNA, 405 bp, Homo sapiens
agggcagtaaaggattggctgtcagaggagacatctttgaggcctccctgggtggagtggggtggcatggagttgaagacccagtcctgatggccctgtagcctgtctgacctgtgggcccctgcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacgct

SEQ ID NO: 55257 - DNA, 1769 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccaggacaagaggaacttaaagaggtgggcattttttctttccagagcactggccaggggggttgtcttgaactactgcctcgggggggggcccggaccccaattttccctttgtggggtcgttttacatttaattggccggcgttt

SEQ ID NO: 55258 - DNA, 1506 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55259 - DNA, 1766 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgagcatcgggcaggttgggggcttgcttgctgtggcttcatttaacctcctccccaccacgtggcctgcagccctcaagcgccgccccacatcctggctggggagatcatcaggccctctcttgtggctgtggctgcaggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55260 - DNA, 2157 bp, Homo sapiens
  misc_feature (1852)..(1852): n is a, c, g, or t
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccaaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctcctagacagcaccaagaaaactcatttggctcgctgaaggatgaagaccggattttcaccaacctgtacggccgccatgactggaggtgagacagtgcccttagtgtgttgggtcccggagcaaggtgtccccttcattgccttncctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccat

SEQ ID NO: 55261 - DNA, 1417 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaactccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55262 - DNA, 1077 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctgtggttggaaaaagcatcaggccaatcttcatttggctgtaccctctggggagtttgcttaatgaaccgggggggggcacccatgacggcccagcacagttacaggtagggaaagcgtcccacggctacattcgc

SEQ ID NO: 55263 - DNA, 1520 bp, Homo sapiens
ggctggtactggtcgccaagccctgtagatctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggtgaggcccagcctggctggggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55264 - DNA, 1040 bp, Homo sapiens
  misc_feature (18)..(18): n is a, c, g, or t
ataggctagtacgaggcnggtgtaaattcggccgaggctaatccggggggaatctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55265 - DNA, 1102 bp, Homo sapiens
aaggggcttcccccctcccaataaataattaaattcttcttacacttcacctgggagaaagattgtgagttttagaagtttcaatagcagaaaagagaacaaaagcttattcctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 55266 - DNA, 1129 bp, Homo sapiens
  misc_feature (888)..(888): n is a, c, g, or t
  misc_feature (891)..(891): n is a, c, g, or t
  misc_feature (1128)..(1128): n is a, c, g, or t
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtggagtgttggtgcccacaatgtggcacgtggagacgnggngtgtcccaaatctgcggcgggaggtccgggttgtggcttggagggacgcatcaggccatatccatttctgggctgtacacctgctgtgggggttttggccttcaatgttggcagtgcgggttcgggggcaccctgtgatccgggcttaccttccactgttacggtgtctgcgggacagcgctggttggcgttgacgtttagcgtctcggtggtggctcctgtggttgtgtgctctcng

SEQ ID NO: 55267 - DNA, 346 bp, Homo sapiens
caccaactggagacccaggaaagccagtgatgtaaatcagtttgagttcaaagacctaagaatgagagaagccaaggtagtaaatcccagtccatgggcaggagaagatgaaatgagatgagatatccaagctcaagcaataaggcagaaaaaaggagcaaattcttccctccttggccttttgtttcattcaagccctcagtggattggatggtgctcatccacattgggaaggcaatccatttactgagtccaacaattcaaatgctaatgtcatccagaaatatcctcacagatacacccagaagtaatgtttaatttgggcatcctgtggcccagtcaagtt

SEQ ID NO: 55268 - DNA, 341 bp, Homo sapiens
gagaccagcctgggcaacacagtgaaaccctcctctctaaaaagaagaaaaaaataagagttttgagtttttccaaagaagaatgctcagtacgtttgttatcagaaagaagaatctggaggtcctgacgtgtaaacagagttgtgggtaccatctcaccagaattgctgccctgaagccaaaggactgagctgctcagatctggaagtaatctgagcccccatttccaagaagagaattgcagaattttataggaagaagggacctgatccctgtcaatggaagcattttaaaatttttaactgaagttccaggagcatacaaaagccaggcaatttacc

SEQ ID NO: 55269 - DNA, 540 bp, Homo sapiens
caactttgacgtaagtttaactgaaatgcgagttagacacatggtcctttagtagaaaatcacagagatgaagcaatgttggaagcaaatgcttttgaccagcataaatgttttgaagaaggtagaaaagatagatgtttatgacagtgactaatgtgagaaacccataggtctaactaaggaaaacatgaaaaaggtcggtaatttggatccttgaaataaaatggccaaccgtgaaaagatagctactgatgaggatactgatggaaaatttgaagcaagttatgtatctgctagagctctgtatgttttgaatgattgttggaatcagcaaagaactagtattttttggtttaatcttcaaggaaaataatagctggaaataaaacaataaaaaaaacactacaaaggagaacatacattaatgtgggaagtagggggaaaaaaaggaaaaagaaggagaacagacttgaagacctcactctctggtgtttgtttcttggtcaggctctgtaaactccccaaaattaagttcttgtg

SEQ ID NO: 55270 - DNA, 382 bp, Homo sapiens
agtacttatgcttttccagcaggcacacagattgctcacagatcttatggaaaggctgccagtgttacttcctcagtgttggggaggtagagcccactaagcctgagccccctgttccctgtctgcacactgtcatacaaagtcacagaataagttaaacacatacacacatgcacacaaacacacacagaaaacatgactcatatgtgacatccctcaacacacttttgaaggactttgccctctgaacctatatggtaaaatagatcttttttattttccaggataaataaagaatgattttgctctgacctattcttctgcagcttgggaagtagatcatacaaatctttgagagttcaacatccatttgcagaatggc

SEQ ID NO: 55271 - DNA, 234 bp, Homo sapiens
tttaaagtctgtgtttgatacttgttctttctgaattattttatgtcaacgtcaacattcgtttggtcttatctgaacacatacagcaaaatgtcacctcttgcaatattttggtttgtattcttctctttatagctttatttttaaaaagtgacttgaattatttacataattttgatgatgatgaattaacttctctgctggggccagggcccttctttctgctgacatccc

SEQ ID NO: 55272 - DNA, 279 bp, Homo sapiens
gtatgatttatcccaaggaaataatctgtaatgcaaactttttaaagcataattttaaaaagattaggtccaatacttgtataatgtatataaaccaaaaagaatattgtggcattctttttaataacaaaaagttgtaaaaaaaaaaaacattatagtaggagaatactttaataaattattttaactctattcagtttaatcatttaccataacaaacagtaatgaataattttgataacatgcattggaaaatgcttataacaagataatagtagg

SEQ ID NO: 55273 - DNA, 407 bp, Homo sapiens
ccagagctgcccgagtgggtcatctcacactgagcatgacttggacctggtgggcgctgggtggtaatgaatgcattcctggttagtccccgtggcaggcacaccctctgcctggagggcatggaaaggagggtcctggcacacgaagtgcactgatgtcacccttctctgggccaaccaagcccagagtccagagatcacattcaggtcctccctttgcctatagcctgcataccctagacctgcatgtgacttttccagtctagaaggaggctgcaagggcgcctggcccttgagagagccagtcttgtgtgtcccagcctctgcagctgtgcggtgagttaggtgctgtaaggcataatttgtaacctcctccctccgatcgcattcactccacatttcactgc

SEQ ID NO: 55274 - DNA, 536 bp, Homo sapiens
gtttcgaactcctgaactcaggtgatccacctgccttggcctcccaaagtgctgggattataggcgtgagccaccatgcccggcctgcaacttttatatttatttcttagaggcagggtcttgctcctttgcccaggctggagtgcagtgatgcaatcatagctcactgcgaccttgaactcctgggctcgttaccctcccacctcagcctcccaaagtgctgggatcacaggcatgagccatcgtccccagctgggaagggcagtttatgtttgtttattttgtgaggcagagtctcactctgttgcccaggctggagtgcagtggcgtgatctcagctcactgcagccttgacctccctgggctcaagtgatcctcccacttcagcctcctgaatagctaggactatgggcgtgtgccactgtggccagctaatttttgtagagatggggtttcaccatacagcctaggctgggagaagcaatttaaataatgtagtattttgtacaccgtacagatggttcccaacttatgat

SEQ ID NO: 55275 - DNA, 398 bp, Homo sapiens
acagaagagagaaatattgtttaaggctagcacatggaaaaacaacttagaggatttagcagctaaaagaagaatgagtcagctggtgatgtgcttggtcaaaacacacagtcatacatgcatatacatataccccaaaatgctaagtggaaactgcatgaattaaaagaggggtatgatagggacattgtcctttgggctaggtaggcacatatcagttggaccacatctgcaatactggattttactgaaatcttgtattttcctttttattatgagaaatttcagctcagtgatcaaagtcttcaaatagttaaaccaaaagaagaatagggctgctttgtgtggccatagagagcaaaactatgatcaaatagtgggtattatggaggaggttg

SEQ ID NO: 55276 - DNA, 877 bp, Homo sapiens
gaaagaataatataattagaaataatacccaggaggtaaaagatgcctgctcgctgaaaagtataacactgatcaaataaattaaagatgcaaataaatggaaaaatattccatgttcgtagattggaagattattgttaaaatttccatacttcccaaagcaatctatagatccagtacaattcctgtcaaaattccattggcatttttcacagaaataggaaaaaacaatcctaaaattcacgtggaaccacagaaagcacctaatcgccaaaacagtcttgagaaagaacaaagctgaagacattgcagttcctgatttcaaattatattaaaacaatttgcttctggcataaaaacagacacatagaccaatgaaacagaacagaatctcagaaataaacctatgaatatagagtcaactaatctttgacaagggtaccaggactacacaatggagaaagaatcgtctcttcaacagttggtgctgggaaaactggatattgacattccaaagatgaaagtggacccttacttacaccgtacataaaaatttagtcaaaatggattaaagacctaaatgaattccctgaaactataaaacatgtaggaaaaaacactgaattataaaggtatttgatactggtcttggtaatgatttttctagatattacacccaaaaaacacaagcaacaaaagcaaaaataaacaggactacatcaagctgacatgcttctgcacagcaaagaaacaatcaacaaaatgaaaaggcaacctacagaatgggaggaaatatctgcaaaccttatgtctgctaagggtttaatatccaaaagataccagaatattaactcagcccaaaacaacaaaacagcaa

SEQ ID NO: 55277 - DNA, 255 bp, Homo sapiens
cagaaaggttgagacacttgccccaggacacacagctgacaaatggcagaagtaagactcccacatcaggcagtctgattccggaggccaaggctcttagctgccacagcatccaccactctccccacatcattctgctccccccacaccccaactgaggccgggccctgtgggttgcaggaaattcactggtggaaaggagtcatcagctttcatgaatgcaaaggctccaatctacacaagaaaagagctgaa

SEQ ID NO: 55278 - DNA, 291 bp, Homo sapiens
ttgctgtctttcttcatattttgcgggaatccctccagccctttgctgcagctttacagcagctggttcccagtgaactgggagttttaaatgtgtccctctggtcaatctgttcattaaataggtggactttagaaaggagttcccgattgctcttactggaatgcaagggatggagcagagaaccctgagtctgcactggggatctgtctaatctcactgtgctcagtcttcctgtgtagtaaatggggagcctgcctgcctcccccagggtggtttcccagccaagtg

SEQ ID NO: 55279 - DNA, 1168 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagaggtctctgatggttctggtttcctgggcacctagaataagtgtgtcaccatttgtcctgaagctgacttctctgagctggatggcaccctggacatcaaccagcccttcaccttcacgtcacacaggagggacactggtccatagagaggatgcctgctctggtcaccagctggagagtggcagaccttgggtacctgacctttggactctgccacacagagcacttcctcagtccctcctgctgcccctggcagggtggagctggcagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55280 - DNA, 932 bp, Homo sapiens
  misc_feature (20)..(20): n is a, c, g, or t
aagagggcagctgtacgccngggattagggatggagactgctttcatcgccagtgtgtcacagaggtctctgatggttctggtttcctgggcacctagaataagtgtgtcaccatttgtcctgaagctgacttctctgagctggatggcaccctggacatcaaccagcccttcaccttcacgtcacacaggagggacactggtccatagagaggatgcctgctctggtcaccagctggagagtggcagaccttgggtacctgacctttggactctgccacacagagcacttcctcagtccctcctgctgcccctggcagggtggagctggcagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55281 - DNA, 1174 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagatggtggaaacctcagaaggccacagtccagagtaggggctcaatgcaagctgctggaactgaataaagctgacttctctgagctggatggcaccctggacatcaaccagcccttcaccttcacgtcacacaggagggacactggtccatagagaggatgcctgctctggtcaccagctggagagtggcagaccttgggtacctgacctttggactctgccacacagagcacttcctcagtccctcctgctgcccctggcagggtggagctggcagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55282 - DNA, 898 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55283 - DNA, 500 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatca

SEQ ID NO: 55284 - DNA, 1237 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagatggtggaaacctcagaaggccacagtccagagtaggggctcaatgcaagctgctggaactgaataaagaggtctctgatggttctggtttcctgggcacctagaataagtgtgtcaccatttgtcctgaagctgacttctctgagctggatggcaccctggacatcaaccagcccttcaccttcacgtcacacaggagggacactggtccatagagaggatgcctgctctggtcaccagctggagagtggcagaccttgggtacctgacctttggactctgccacacagagcacttcctcagtccctcctgctgcccctggcagggtggagctggcagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55285 - DNA, 1018 bp, Homo sapiens
agcggagtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgtgagctacctgttttgctctaagataccctggatgtgacgctcagctctgtcactggcttccacataccccctactcctacacctcaaaaatccatgttccccacgcattcatcttcaggatggaagaaggaaaagtatttttaaaagacaatctgaagctcatactgtgactgcaacataaaatgtgttcacctgaggagactgctttcatcgccagtgtgtcacagggcagctgatccaggaccgtccacttccaagccagcaggaggatggaaaagcagaatggaggggaaacaacctcctttgcagggcgtgactcggaagttggacacatcatttccagccacattccatggaccagaattagccctgtgaccaactctggctgccagaaaatctgggaaatacagtctctgcttgggcgatcaggcaggcagttatatctttgggaacatctctcaccccctgggaacacctgagcagaaactgaaggacatttaacagattctcctttgtgtctaataagaattgcccccatcagtcggggctgtcctaggtgctgggtacataggtcatctatacacaacccagcaatggagagcacaccattcccaggctgcagatgcagaaactgtggctcggagagttaagcgtcttgttcagattcagtcagctggtagatggcaggtctgggattgagacccaggcctggctggtcctgccaggatacagtatcacagctttgactgggagcttctttttgtttacatatattttttatgctcaatgtgcattccttttgaaatacacagaaaagggaaagaag

SEQ ID NO: 55286 - DNA, 492 bp, Homo sapiens
gctgataaaggtaactgccatctccaatgcagtgtaactacttggtgccagcatgcatcgtggtgctcatctttctggccttccagcagagggcatatgtggcccctgccaacctgcctgctctcctgctgttgctactactgtatgggtgaggcccccagtccctcagggcctattcttactgaccccttactgccttccacattaatgctgctgagatagaactctgcagtgactcccaaggagaggatatggaggtctgaggtgatgccgtgtgtgatccaattcagtggtgtgccaaggtggccttaaaagctcatcttatcctgactcatattagtagagttctaaggcagcccatgcctgtaattccagtactttgggaggccgaggcaggaggactgcttgtggccaggagtttgagaccagcctgggaaacatagagagacccacctctaaaaaagaaagaaagagagagaaagagaaagagag

SEQ ID NO: 55287 - DNA, 6219 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55288 - DNA, 6759 bp, Homo sapiens
ggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55289 - DNA, 6255 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccataggtgggccgggctctgatgccctgggctgtggttaagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55290 - DNA, 5823 bp, Homo sapiens
cgcgcggccccctccagccctctggacactttgtccttcatggaggttggtggtggatgttggccccagggtgttgggctaagccatagggctgtgtcctagtacctggattactgtttaagtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccataggtgggccgggctctgatgccctgggctgtggttaagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55291 - DNA, 2445 bp, Homo sapiens
ggtgtatgtgccagaccttaatcctgttatatctggatacattaaaagcgtgtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccataggtgggccgggctctgatgccctgggctgtggttaagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55292 - DNA, 5271 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgaggtgagtccaggggtggaggccaggtgcagggacagtgagtggctgccctactgcatgccctgcccatcatcctttactgaacacctactgtgtatccaccaccttttattgggcacctactgtatgccaatatttgtgctcctatttttattttattatattattatttatttaaaaaaaaaaaa

SEQ ID NO: 55293 - DNA, 6198 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55294 - DNA, 4954 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagccccctgggtggctccttggaccacccgctcccgttcacgggctacatcct

SEQ ID NO: 55295 - DNA, 641 bp, Homo sapiens
tcaagtggggtgatagcttcgagagcaacctgggcaacctagggagaccccatctctataaaaaatttaaaaattagctggacatggtgattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaagca

SEQ ID NO: 55296 - DNA, 4847 bp, Homo sapiens
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatgggtgaggcccccagtccctcagggcctattcttactgaccccttactgccttccacattaatgctgctgagatagaactctgcagtgactcccaaggagaggatatggaggtctgaggtgatgccgtgtgtgatccaattcagtggtgtgccaaggtggccttaaaagctcatcttatcctgactcatattagtagagttctaaggcagcccatgcctgtaattccagtactttgggaggccgaggcaggaggactgcttgtggccaggagtttgagaccagcctgggaaacatagagagacccacctctaaaaaagaaagaaagagagagaaagagaaagagag

SEQ ID NO: 55297 - DNA, 294 bp, Homo sapiens
ccaccccttgaacctcaccaaggagcagctgtctgaggctgcactgtgagtccctccaccctgcatgtcctaccctgcacgtcctaccctgcctccatttctctgtcgtttggggtggtgggagctggatttgaaccctgacacactcttgctttataaatgggggatagaaactgttcctctgctccctaagccagggaaatgggacctcctcagactcagcgggccccagcctcccccacacatcctcatcccaccaacctttatcctgcctgagacctgtacaacctctgc

SEQ ID NO: 55298 - DNA, 363 bp, Homo sapiens
gtgtgaggcctgggtggtggtgaggtggggccaggaggagggcttcctggaggaggtggtgttttgaaggatgaatagcgtgtttatgagcagcaaggacattcagggaggaggcatggcacatgaggagctctggtggctcagatgtcccttgggaaggcctgggggacccatggtgtaggaggggtggggggctcacaagcccccagttctccctgtcggtgtccagtctctgagcccctgcttgtctccccagatcttcctgaaggtggtggaggagtgtgctgcggacacagatatggagggtgcggccacagctccctgacccctgaccccagtccagagtgggaccagaggccaggt

SEQ ID NO: 55299 - DNA, 2773 bp, Homo sapiens
cgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgcttc

SEQ ID NO: 55300 - DNA, 3046 bp, Homo sapiens
cgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggggtttcaccgtgtgggccaggctggtctcgaactcctgacctcgtgatctacccacctcggcctccccaagtgctgggattacaggcgtgagctagcatgcctggccagggattaaaatattcaaacatgttgtgtgtacccagatatgctgttacttcaggaacaaacagtacaatttctatgaagtggtcgtgactatttcctgtagtcacatacagtgcgggatatctgatctatttctcgtgttctacttgggcaaatgcatggactactcaactaaccatttagctggataattaacaagggacatcacacagcacacacacag

SEQ ID NO: 55301 - DNA, 1023 bp, Homo sapiens
aaatggcgtgaacccaggaggcggagcttacagtgagtggagatcgcgccactgcactccagcctgggtgacagagcaagactccgtctcaaaaaaaaaaaaaaaaaagtcagacatctgcactctgcttaaatccctgcattaaatgatcctcatttcatttagagtaaaaatctacatccttacaatagtctaaagggttctataagatcagcatcaccactccaccctgagcattacttctctaatctcatttcctatcagtcattctccaatatgtcctaaccttcccgacctcttttcttgtccctagaagatgccagccatgctcccaagttagggcctctgcactggctgtgccctctgccttgtacatgtttcccccagatatctgcattgccaactctctcacctcctttggtcaaaagttacctcattgaagcctatcttgaccttttaaaaatcacagcccattcttaactctcacagtacacccaaagcccctttaccctgctttctgttttactatagcacttctgacatactatatgatttacttatgtgttgtgtttattgtttattgcctattaccccccgctagaatgtaagctccatgagggcaaggatttatctgtagtgtttaccagtgtatcccaagtgcctagagtagctattgacacgtaggaggtgctcaataaatatttgttgaatgaatgaacaaggtgtttgtgcttctatccatagaagtgaaaactaggattaggtttgacccaattctatttcattcagcaaaaatatcctttaattttaatagataccaaaatatgtaatattttatgttgtttagatcaattagatattaaaattatacaatcaaaatgagctttttaagcttatcagactcagtcaagaatttttttaaaaaaatttttttgtagggaaatatgataggttgatcaataaaagactctccagcttaaaatattatattaaaatattgaggggtaagtggaatggaaatac

SEQ ID NO: 55302 - DNA, 290 bp, Homo sapiens
ttaaataaaaggtactttattagtattttgtaaaatctgatttttaataactaaaaaagtttgtcaattagttgtttgcactggttagaataataattccttaacagaaaaacaacaatgccaatcacactatatcaaacacaagcttacaatagctaagaaataaatagattttatttttaaaattgtgaattttaatagataagtgaaatttgatattgatattagaagaggttattccatgttttctcaaagtcaggatgcaggaggtagagagaatatttcctaaa

SEQ ID NO: 55303 - DNA, 2342 bp, Homo sapiens
  misc_feature (1679)..(1679): n is a, c, g, or t
gaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttaggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcggtcatattggactatgacactgacgtctctctggagaagatccaacccatcacacaaaacggtcagcacccaacctgaactcgcagatgaatcctgccacacatgctcatcccaaaagctagaggagattgctctggggnttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctaga

SEQ ID NO: 55304 - DNA, 430 bp, Homo sapiens
tgattgagtcatgtgcccacctgtggatttattgctttgacctagaaagtagtgcatttcaattggccagtctcctgggttacagccacacttccaccgtgccgtccattgttggggtggagcactggaactgacagtcctgctgttactgtgagaagtgggaacatggtggtctcctaagtgaggggagactagagagatgagcaagagggaatttccacatgtgtgatagagaatgagatagtgaaaagacctttttattgtaattgggtttcagaaactctgagatacctttaatttaagcttcattgaaataacttcagtagggaggtctgaattaagtcttttctcaactaacaggagttacattatgttttatagggttcagggaaaaggatccaataaaaggtgagaaaagtatggagaaaag

SEQ ID NO: 55305 - DNA, 374 bp, Homo sapiens
agcagaggtgaaaataagaatattataagcaacttgatgccaataaattttaaaacttgaatacaatggatgcattctaagaatactttaaattacttcagtattagaaaacttaattgccctttaactattaaggaaatggagttagttctttaaaaattgcccacaaagaaaataccaaatcaccatagttttgtaagtgaaatctacccaagattctaggaacaaataattctaatcttatacaaactcagaacttaggaaggaattctctgtggtagttaaaaaatatgtttacaatctcttgatattttggagccctgttccccttgccttgagtgtgggctggacctaatcatgcaattctaacagaa

SEQ ID NO: 55306 - DNA, 402 bp, Homo sapiens
  misc_feature (330)..(330): n is a, c, g, or t
  misc_feature (387)..(387): n is a, c, g, or t
  misc_feature (400)..(400): n is a, c, g, or t
taggaagttaggaaatgcgccttgagagcgtggcttgcaccaacgatgcttgaattcaggctgggccacctcccctatgtccactgcccgcctctgttcttctacaccgactaccttgtgcaaaggaggggcacacagagcttgaaaccaccgcccccagtactccccctctcccccaaggtgcgtcctaggcaggtccagtgacaaacatacacaatttctagagttaccgcggctggcaagagtagaactcgctttgctaattcaggaacggaagttggagatttttgttgattgttttaaagtggctcgaatcctttcaacctgggnccaatacaaaactaccacccagccagggatgagggggagggaccattcttgttttcnatcggcccctggntt

SEQ ID NO: 55307 - DNA, 374 bp, Homo sapiens
gaacttcaaaaaaaaaaaaaaagaggaatcataataaatattttactgtctagtcaacccaatttatgaagcctgattatctagctcagcctccggagattgctaccggaaatctccccagatgttcccccttctaacccaactctccactgtctggcaggaaggcagccgggcatctgcattccggaagcccagctgcttgggaagagagagggagcggcctgcacgtcactcaacagccctgcctgctaaccagttaaccagttctcagttgggttcacggacccatgagcgacccagctttcttcccctcaggttgatattgtgctccaagctggggatgcccggggactatgtggagggagagtgcctga

SEQ ID NO: 55308 - DNA, 790 bp, Homo sapiens
ggaagacttgggtgaagggtagtcgacagaatcggaagcgggagtccctgtgggtcctgctggtgagcagctttccgtgattatgggttttttttttttaaagtttctattgctaaccatttacaaaaagaaggaccattcttcgctcctgctggttgtagtctggagtgattccagaaggctagatttcggtagtttctattttatctcctcctgtactactggtacgtgctcacagcccaagcctgcacgcacaccttcattcaccaaagcgcaaatgcatctttaaatcgtcgctgtttttgaagtctctagagagttgtcattccactgtggtttagctgtttctgagaagtgtgtgtgctgaagcttgtggttaatatcacttcacagttatcaagtagaggaacttttcctattcaggttccatccttaaatcaatgcagtggtttaaggttacttagatagcagcagttgggtctgtgttagtgtgttgacactcattccaagtggcttcagaggagtcacctgctgggattttcctagactctttgcacttaagcaaagctactgtctccctcccaggtcaactttttaatgtccaacaacagaaactttacattatcccttattaaaggtctagagaatagcatgtaaggtgatttctagataatctcacaactaatttattattttcagagatggtttgccctcctatcctaccaaatcgaattaaactcgtttgagtttctttttttctcccgtgtgttgattcatggtggagcttcta

SEQ ID NO: 55309 - DNA, 254 bp, Homo sapiens
aagggataattcttaggtgaaataattatagagaatttatattttatctaaagcaaggaaaaatgtgggggtaaaagttcagtcaggatggccaggaaaagcagacactcttacatgtggagattttcttaaagttgttaagtttttaaatgggattattgcctttggggtggaaccttttaaggaacagaaccaggaaagcatgcagtttctaggtcctagtaatcaggcagaggtggaagtcaaaacagatt

SEQ ID NO: 55310 - DNA, 219 bp, Homo sapiens
tgcataagatgtgacactagttgtaccttcagaaatgaaaacaattctgtgatcagagaatagagagaatgcaaaaatgggataggagaaaaggctgggcaagatagaagagactatcctgtttgcaatgtccagcttagccttaagagaaacgagaagacacagagaaattgaaagcaggagaatatcataatgtgggataaatgagccttccaaaat

SEQ ID NO: 55311 - DNA, 590 bp, Homo sapiens
caatcacagattctgctagttctcttggctcaccctctcctacaatattagctgcctttatacggaatctgtactcatttccttcaattagtccaggtaccctaaaggcacattgcctaatgagttcatctttattaatcctgttccattgtgctgtgccaggtttctgacattccactacatatcctagaatggggctaccaccatcactgagaggctttgtccacaccaaatcagctgtttctctgctcttgtctttcagtttaggattaataggtggtccaggtggtttgatgggccggcaagcttttattggatcagaacttggggatggtttgcttagtcctgcaagattttcagcaaaaactctaaactcatatgtatttccttcatagagtccagtcactctgaacttcaggtcagcgataggtgttttgttgaccctcacccatttgccagttacttctcgacgttccatatagtagccagttattggactgccaccatcagattttggcagggtccaagacactgttgctgcattttcagtaatgtcagtaaccactggtttaccaggaggagacggagga

SEQ ID NO: 55312 - DNA, 287 bp, Homo sapiens
tttttttttttctgtcacccaggctggagtgcggtggcgttattgtttctgatgctatttcatactaaacaagttacaggttgtcctatacttctgatttaaaatttaaatcagtgttaaaacttaaaagtattgtgcaacagcaagaaccataggttcagcttactgtatatgtccaattagtgttgctattactattaacaggactaatacaaatatggtatgatcatttgacacattaagctaaataaacaggtaatgactaattttgcacaatgctaattatg

SEQ ID NO: 55313 - DNA, 459 bp, Homo sapiens
actgaaatatctgaataaataaattaatgacctgtaacatcacttctatccttaaatacatattctggtggggggaaaaaaaagagcaaatctgcatctcattcaacttcctgatttctctctgttgtccggatgtgttagattaaatacgaccacagattctttgcagctcctcctataaagaggtggagtctattttcccactctttgaaactgatctgtccttgtgacttgctttgatagaatgcaacagaagtgatataatgtggcttctgaacttctattttaagacgctttgcagtttttacttttgccttcttggaatacttccagaatcatataaaaagtccaggtgaaagtttgcacagagagagagcttcgcagttttcagggccatgccagtcatcctactgaggccctaggcatgtgaatgaagccatcttagagtcccaagcccca

SEQ ID NO: 55314 - DNA, 1161 bp, Homo sapiens
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccccatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgaggaatctcgctgggcgcacatccagaacaccgcagccaagaagaccctcctgcttggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttctctctagcc

SEQ ID NO: 55315 - DNA, 422 bp, Homo sapiens
agagaagtacagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaaggaaacgtttgtgagtgaaaggtgttgctattaatccttactcaggaacaaccaccataaaccaagaatatcccaggccaacaaggacatagtcgttgtattcaaagctgcaataaatagagattgactcataaaaaaaaaatgataaaatttaaagaaa

SEQ ID NO: 55316 - DNA, 704 bp, Homo sapiens
agagaagtacagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaagccccccactgacaaggtactggcagcaaaaaagatccagtcctgatggtggggcacgctggtgcaatgcacactactgcacgtgaccctcagagctttgatcattcagtgctggtggaggcaggtgctggcaaggctgcaggcgaagaggcagcgggcagcactggagctctgtgcacggcagctatgggcagcagtcaggctgcagtcctgggtccgcatgtggcgtgtccgctggcgttactgtcgtttgctcaacgctgtccgcatcatccaggtctattggcgctggagaagttgccatacccgtggctttttccatggcagctacgagctcacaacaagccagctgagccttgagcttgacatcttcctgggatcacatatttgccgaattacagactgcatccccttcccaataaagaagtgacaaggtgctcca

SEQ ID NO: 55317 - DNA, 487 bp, Homo sapiens
accctgaaaagtggaaagcagacatgcaacattggagcatggcatgccccccactgacaaggtactggcagcaaaaaagatccagtcctgatggtggggcacgctggtgcaatgcacactactgcacgtgaccctcagagctttgatcattcagtgctggtggaggcaggtgctggcaaggctgcaggcgaagaggcagcgggcagcactggagctctgtgcacggcagctatgggcagcagtcaggctgcagtcctgggtccgcatgtggcgtgtccgctggcgttactgtcgtttgctcaacgctgtccgcatcatccaggtctattggcgctggagaagttgccatacccgtggctttttccatggcagctacgagctcacaacaagccagctgagccttgagcttgacatcttcctgggatcacatatttgccgaattacagactgcatccccttcccaataaagaagtgacaaggtgctcca

SEQ ID NO: 55318 - DNA, 292 bp, Homo sapiens
tgaattcctgaggtcttttatttacatccataaatttgaaaagcacaatcccctttttttttttaaaaaaaaaaaaaggaagttacttttgggaatcagagacatgtacctctttgttctcttggagagctgtgggttatgggagggaactcctcatcctgtttcctgatatgcagtgacttctctcttacacagatgagtcctaaaacctttgtgagctcagacaagttggctggttttatttttatttttttatttttgagattgtctcactctgtcactcaggatggag

SEQ ID NO: 55319 - DNA, 415 bp, Homo sapiens
gagatgtttaaaaatgaagtggaagttttttgtttttgttttgtttttgcagaaaaaagatttttaatggcttgaatgtgctgccatagttgcgtcagattgtcagaaaattatgttgtacatctgagagagaaaagaagagccttttgaggagctgcgctaaaattattttttgtttagtctcttaactctttggcttgaatgagtcattgactttccttgccaagatagggttagcatttgttttgtgttttaaaagcaggccaagggattgccacgaggggagacaacctgagcaactgaaggaagaattgctagaaattgtgttacagttgtttagtctgaatgtgattagaaacaacaacaaaaatgacctaacattattgacttcaaaatttgttttctgctttcttcc

SEQ ID NO: 55320 - DNA, 354 bp, Homo sapiens
ccactaccacaggaaatctctatacccttcttggcttttccttttaatgtaattttcttaaaagcttcaagataatttttaatcaggcatgctgaaatctatctaacctattagtcactaattatattcttcaagcctatatattaatgtttctactgttgtaaattcatgatcataaagttttggacctggccatcaatactaaagcactgatatttagttttaggtgatacttgggcataaatacaaacacgaatatattttgtcatagaaaaaaatgtgttactgcattattttgcacttctgaaagaactgcaaacatttttcaagcacaataagcaaattcttctttca

SEQ ID NO: 55321 - DNA, 160 bp, Homo sapiens
attcaggttgtagaatatctggaatgtcatattaagactcttagacacttgtttctgtgcaaatgaaggggttttcttgggtttaactaaacttcaaattcagaaagcttgtttactcagaaggctatcagacaggaatcatagtttgccagcagggcag

SEQ ID NO: 55322 - DNA, 1882 bp, Homo sapiens
ccaaagtgctggaattacaggcgtgagccaccacacccagctagaagtattctttaaacagatgggtgcagtagcatttacttcatatcttgcaccttgggagggagaatataacttgcctaatggcataataattgatttccccccttgtcactttagaataagactttataacgcccccagaaagagtcgaagatgaaacatgacaaaccagaaaaatttattggccaaggtgtccactccacttggtaactttttgagggcctgatctggggttatctgtcctgtaagaagattaagatcaacccagttaaaacacggtgggccccatccctgctaagaccaggttacaggataaaactctcatccctcttggttgttaagacgaaattttcattcacttaaagcataaatcctttgcataatatttttatgcttgttcttctcctgtgtgtaaacctttatttggcgccttctctcttctgtgggattgactttttagggcaaatgagaattttgaagataattactctcctcctccattcctgtatctttaacaactgccaggtcccagtgacactttgataaaatgtttttagagccagtcacttgtgttgctgtggtctgccttgtcgtagaggcacatcatttttgcacatcagtattaacagttcaaacaccctgaaatgctaatagcactagtaagcttttaattccatggaatttattgcttgctgtgtttccatgaatttataacgctttgattcttaagagccccatttaatcagttttgcctggcaccgaacataataaacaacttgctggtgaaaaagtgccactcggggaggctgctaacaaggaagttaaatgcttctgccacgagcagtttcttcgctgtatttttcatgagctgtaatgtactttgctggcttcagagcggtggttaaacacagtgacaaaccgaacccactccagcactcggaaactcagactttgctaggtgctttggcaaaaagtatagaagaaatcaacactttcagccttttcccccctgcctctaacttattggtttctaatactttttcattatctttaccttaatctcttagcatatgatttatggactggaatggtgagtgatatcagtgggcaaaaacaatcattagaggctgttaaggaacatttattgtttatttggctacctgtctataaaagtacacatgaaggccctaatagcaaaatatcaaattatcaagtgctttaaagcagaaaatgtcatttgtttctcaaaactgcaccaactttatataattgcccttttaattatccctagtggcccgtgaaatttgcaaaatagagcatcaaagctttgatttacttacatgttgcactttggcgggattcttaatgaatattgtttagtactaatgctgagatggaattcgtaaatgtttatagtgagggacttacttagaagagtggggaggccagtaatgaaactgaatcaactgggttcttcaagatggaacaatatggccatattcttgggcctaacattttgaaaaattctttttatagtggaattttatttttaattcaggtctagatgaatacacattaagtttagttttgcagaatctttttttttctgcctagctatcttattactttccaagggcttttgaggagtaatttgtttcctggcaatttcggattaaaatcacctgtttcttcataaattgtcatcttcaaggtaacactgagaactggatctctgaaatctcatgttttcgagatgatttttatagctgcagacctgtgggctgattccagactgagagttgaagttttgtgtgcatcatcatgtgccattaaatgaaaa

SEQ ID NO: 55323 - DNA, 329 bp, Homo sapiens
taagcctaacttgcgatctcaccagaaaggattagtttggtataagttaaattaatttcttttccagcaattgtatatgttagctattggctgatcctgaaaagcagtatatttatgttaaatttccagatttcctttggtagctaatcaaggaggaacagctgctagagttcattttcatagattctttctgttctcatatctggcctcctcagtgatttgaagaattgaatatcctccaaaaaatggatattattacctcctgttctctgatggtgatggagacttcattctcagattgtttttaaattcctttcataattccatat

SEQ ID NO: 55324 - DNA, 490 bp, Homo sapiens
acaaagagatcaaaggtggggattctttctgtctgccttacaattttcagagggttttcagcccatttccaaaagtgctttctacatcagtgctacatgatcagtacagttgcgtacttgctacttccttaaagaaaacttgggatacagagctaagactatttccttagtccagaggatctttcaggtgattttcaaagggatccgtgactccaaacaggaaacggtgaacactgttggctcatcactgtctctttttcctctggttttgattctgaagcagggaagcttggaaagatgggccgctgagagtctggaatgcctttgtctgctttattgtggttgtttgtttgtttgtttattttttgtgatggagtctcactctgtcgcccaggctgcaatgcagtggcatgatctcagctcactgcaccctttgcctcccaggttcaagggactttactgtttcagcctccagagcatctgggattac

SEQ ID NO: 55325 - DNA, 381 bp, Homo sapiens
tacctctttgatttcaggcctccttatctaacttctgctcagtcacctctgcattctacctgtagaaaagtgactcaacatcattccagaagtccggaattctacaagaatcatttctctaaacagcatcatagtctatcaagctgtgagaccaaaaacctgagtcatccttgagtccttttccgtttgctcccaacagttaaatggaatctatcagcaagtcctgttggttttgcctccaaaatagatccgtaaattcacttaggctcttatcacttgattgctactacttcagtcaaaaccaccctacatacaaatccacactctaccctctagccacaacgatctattacaattacaaatgagagcatgtcttttccc

SEQ ID NO: 55326 - DNA, 184 bp, Homo sapiens
  misc_feature (104)..(104): n is a, c, g, or t
  misc_feature (109)..(109): n is a, c, g, or t
  misc_feature (183)..(184): n is a, c, g, or t
gcacaatctctctgtcagacaagccagctgactgatgctacctggttaagacagtgggtcctggagctgctttgttttcacatttaggatatggtggatttggnaggtntggcccatccaggtggatggagaagagggtgactgtgaggatgttggttgggactccctctctgcccaacccann

SEQ ID NO: 55327 - DNA, 515 bp, Homo sapiens
tttactgagcctcagattcccgcttgcactactccagctgttgctgccgcagctgcctttcccagacagaagcgctgcgttgcaattcttcagttacaatctgggtaataaaggaaatcatattaaaactacagatttttgtattttaaagcgcgatttccttcccccgagtagcgcgtggcggagatggttggtgacccctgcggtgcaatcatccaacgaaaacttcactgctctgcaccagtttttctttttctgggtttagaaggggagttgtgactacaatactttaaaaaacaaaactacctttattgtggcaagagaaaacattacaatggaaacaaattacatataaatagttgttttctcggtagcttgttgttctttttgtcttttgtaaatttctttggtggtcttaagtcctgatttggccttgactacagtacaggagcccatggacctagaccagagaccacggaccctgaaaatacccactgatctacaccgagattgaa

SEQ ID NO: 55328 - DNA, 344 bp, Homo sapiens
tttactgagcctcagattcccgcttgcactactccagctgttgctgccgcagctgcctttcccagacagaagcgctgcgttgcaattcttcagttacaatctgggtaataaaggaaatcatattaaaactacagatttttgtattttaaagcgcgatttccttcccccgagtagcgcgtggcggagatggttggtgacccctgcggtgcaatcatccaacgaaaacttcactgctctgcaccagtttttctttttctgggtttagaaggggagtaaaggcctctccaacttccttgaacttcttctcctcctccttctgaacctcagcactggctccactatgc

SEQ ID NO: 55329 - DNA, 718 bp, Homo sapiens
gtggtcccctctctgctcagcctgcctgagctggtctgagggtcctgatttttcaccagtgccttcccttctactgttccctgaggacaggcacccccagatggaaactctgacttgccctctacctcatctccacaggaaccttcctcctcaaaaatcaaagaacacagtggatgcgaaaatattccataaatggaaaaacgtagatgtagagaagaactaagccacatctgtcgagggccctgcacttgccaggtcatgagctatgaagttgatttactgacccatgaatgggtcacaacccgcagtttggaaacagctggatggacccccacctgtgctttccagcttctcctagagcctcagggccccaggaaggcagtgtggtctctgcaaccaggtccttctcctgggagaaacacttcaacttttgcaaaagattcattaattcatcaccatggcacccagaaaaaaaaaatgcagaagagaagactcaagttgtggccgacccaaggtggctgcaaactgtttgagattttcctcgttgagaagtgggggtctaagttccctcccttgaacctaggcaggccctctgactgcctaaccaacagaaatagcatggaagcgacactgtaccggtttttgaggctaagcctgaagagactggcagttcccacttcctgtcatctgggaataattgttcttgaaacctaagtgc

SEQ ID NO: 55330 - DNA, 787 bp, Homo sapiens
gtggtcccctctctgctcagcctgcctgagctggtctgagggtcctgatttttcaccagtgccttcccttctactgttccctgaggacaggcacccccagatggaaactctgacttgccctctacctcatctccacaggaaccttcctcctcaaaaatcaaagaacacagtggatgcgaaaatattccataaatggaaaaacgtagatgtagagaagaactaagccacatctgtcgagggccctgcacttgccagatcgcctcactccagcaacaacgtggaccatagcatctcacttctagaacccttgtcactgtttcaaaggtcatgagctatgaagttgatttactgacccatgaatgggtcacaacccgcagtttggaaacagctggatggacccccacctgtgctttccagcttctcctagagcctcagggccccaggaaggcagtgtggtctctgcaaccaggtccttctcctgggagaaacacttcaacttttgcaaaagattcattaattcatcaccatggcacccagaaaaaaaaaatgcagaagagaagactcaagttgtggccgacccaaggtggctgcaaactgtttgagattttcctcgttgagaagtgggggtctaagttccctcccttgaacctaggcaggccctctgactgcctaaccaacagaaatagcatggaagcgacactgtaccggtttttgaggctaagcctgaagagactggcagttcccacttcctgtcatctgggaataattgttcttgaaacctaagtgc

SEQ ID NO: 55331 - DNA, 485 bp, Homo sapiens
ttccttgtgtgcggtatagagtatatttggatttcctacctaaacttgagaatgtacaagttatttcttgcttccccagtttaatgttcagtgtcaatttgaggtcccttattatgtttgaatacatccattacctgctgtgagtatagatttgtcttcttatcaataagcaaaccgttagggttatagtcctgaggatagaggaaagacttttgcactcttgagaaactaggaaaagaactttctgaagcttccctcctggtaggaaatccaacctagaagtcgactggatggggacagccctggcaataagttttctcttctgtcaagatagtgctaatggaagggaagtcttggttgttttgctttgctttgtttttgataaaaacaaatattttgggcttcatggatagcgggaaggtgtttgagggagctgagtcacagtagctgggttggctgaaaagggcagtaggaacagagactct

SEQ ID NO: 55332 - DNA, 434 bp, Homo sapiens
cagatacaagaatccagccagacattaaagatttgcaaaactgtaaaacaatgccactcttgccactaaattttctttttaagaatataaagggatcctgaggtcaaagagtttttgagaacctctaaaccagattttagaattactctgttcaggccgggcaagtggctcaagcctgtaatcctagcactttgggaggccgaggtgggtggattgcttgaggccaggagttcgaggccagcctggccaacatggtgaaaccccgtctctactaaaaatacaaaaattggtcagacgtggtggcatgcgcctgtgatcccagctacttgagaggctgcggtaggaggatctcttgaacccaggaggtggaggttgcagtgagctgagatcttgccatacactccaggctgggcaacagagtgagactctgcttc

SEQ ID NO: 55333 - DNA, 323 bp, Homo sapiens
tacttgactaggtcaataaagataaggcactaaagataggcaatctaaatgccattttacacatatggtggatggataactctgtgtcctaatatttctgaaccttagttaccttatatgtaaagtaaaaaaaagtaccaatccatacatccatttcctttttgccatctcttgtcgactaggcacttttcaggattttccaaggagatcattgaaactttgttttgcttttctgcaaagatgtgtatatgaagttgtgtttgctgtctggccttatgagagactcagtgcttttctgacactaacattctggggctctttgt

SEQ ID NO: 55334 - DNA, 226 bp, Homo sapiens
caatttagcagcaatctgcttggattgatagccactgataaccagatgcttgaagaatgtctctgtgggcactcaggtgaacaggtggcctgagacccacaggcttttgtcctctgtgaacacccagacttagcctctgcctttggaaggtgatgggttcttgaaagtattgagcttaagtacatcagaatagcatcttaaactataaagttagttattaacgctt

SEQ ID NO: 55335 - DNA, 289 bp, Homo sapiens
cggtggtggcgccgcgctgggaatccgctgcggagtgagttcgcctcgccccgttcgcttcggtccctgatcccagtcggggtggggctaagctgaccaccctgctgtggctccgcctctttctcctgtatttccctcacttgtgtcccatccccgggaggctctcgcttgcactgcagcctttatggtgagcagcgccctgggccaacttgcccttttcggatggagtcagggagggaggagagactcgaatagggtattactgtaaggaaacgaggtcctcctagcg

SEQ ID NO: 55336 - DNA, 1039 bp, Homo sapiens
ttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtg

SEQ ID NO: 55337 - DNA, 490 bp, Homo sapiens
gaggggcacacgggcattgacggcacttctgtgctttgaggaatttgacagcacagacatctagagtaacgtctgttccacttcctctcttgtcgttcaattgttgtcctgctgttctggtccatgtcctaaccctgccggggatccttggtctggcagctgggtacttgcttccccgtcctgtccctttgccgatgtcccctaagtccccacaattctgccggacaatggttgacaatggatcaagacatacaactcacccactttaacgtcttttccccattgccttgggggaatctgtgtgggtttagcttttgcaaaaaatgttcctcctagatcaaaagaggaaattctcttaagattttaggacttcactcactgtgatacttgacccagcaaataaaagatgtatgtattcctcctctggcatatttttctcttaatttaaagaacttgttttgaagcaagcgccatttccaaggaagcttca

SEQ ID NO: 55338 - DNA, 388 bp, Homo sapiens
gctgaaaatgtttcatgttaattgggaagaccaaaagcggtatttaacatttttgccctgacgttcctccactgccttgtgggaagactcttaggattaaattagctaggaaaataatgttttagaatcagtttctttttataataggtagggtactttaaaaaaaaatctcggcttcccaaagccgtttctgtggtgatgaagggaattcagagaagcacatgttttgtaaatccacaaaagagtagctgctttggaaattcataagatgcctgtgggaatgcatttctcgtgtgcatggtggtaaaatggcagttaaactggaaacaatgaaggacagtgaaatccaatatgttatattggattcagcagtgggctatggtggcag

SEQ ID NO: 55339 - DNA, 437 bp, Homo sapiens
ttgtggtggggaacaatgttcaacaaaacagaagagttatgggtgctctagcttggcaacggagaatacttccttgtgctactaaatgccaatatttgacaattacggatgacacaattgagcaacagcattcactgtttaacaagcagtgtctctggaacactgggttagtgctgtcagatgttgactgaaaagtcagtggtttgagcccatccagtcatattaatgtttctagctgacgtgaccttccatctgaagagtctcttccttggaccaaatatctcttaaagcttctcttcttcttgtctcttgtctattttctaaggtgcctctttgttgcttggggcaaaaaaagtccatttttaatccacacccaacaaacatctacccttacgtatccggtttttagggttttgagtttgttgtttgttttctca

SEQ ID NO: 55340 - DNA, 661 bp, Homo sapiens
cgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaaaagcacttgcaggcctgaaatagggcgactgggaaggcgatatggagtcctccttcggcctcgtctgtgaggtggg

SEQ ID NO: 55341 - DNA, 640 bp, Homo sapiens
  misc_feature (559)..(559): n is a, c, g, or t
cgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtcccttatattcgcccatgaacgacactgcttcacagtaactgcggattgaatggttgcatccaaccagncgggtaggaactcgcaggacggcctcatgaaccctttatcgttgctcatgaggggctttttacacatcagcgaaatgtacg

SEQ ID NO: 55342 - DNA, 370 bp, Homo sapiens
gagctgggattacagatgtgcaccaccatgcctcttttatcaatatcataggaaaaaaaaaggtgtttcaagaaaaatatggccggaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatggacagagtcctggggggat

SEQ ID NO: 55343 - DNA, 2745 bp, Homo sapiens
cgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctgggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctattgaccctgaccactaactagtgattcttctccaaaattgagaaagacagcacccattgaagcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaatgca

SEQ ID NO: 55344 - DNA, 2799 bp, Homo sapiens
cgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctgggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaagcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaatgca

SEQ ID NO: 55345 - DNA, 2528 bp, Homo sapiens
tgctgagcaagtcccacttccctcataacctcaggggaagaggctggacacatgctgtcacttttctccaagagggggctcagtggcaaatgttgagctggtgatagtattgccaatgagaaattagcctgccctgctttcaaggatgtgaccatgatatcccaagagaaggaaggctttgaaggcagacatgtgcctggttaggaagatggagctaaagttaggatacagcttgggagaccctccagaataaaaggatattgacaagatcacacctgagtggagacaagaaaggaacagccccggaagcaagtaaaaggaggaggagaaactcgctcatcaaggacctttgaagttcagattgggatgtacacaggaatggaggaaaaaggaggaggctgccctcatggctggaggggagggggaatggagatggcacaagttgcaatgtgcctaagactggtgatgttagcttgctgtttgattttccaacagccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctgggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaagcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaatgca

SEQ ID NO: 55346 - DNA, 1432 bp, Homo sapiens
cgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggtgagtggccacaactgctcccatctagccttttccctttacaaggtcctttttgtttctaagttacccagtgacttttggtttgtttggttaatagtcaagcagaaaatgaaacccacaaagtgaaagatagatgagtagctctttagatatcaaagtggctttagatcaggaagattgagtttgacagggcagaagatgtccctaaaagtaggaaaatgcctcttttatcaatatcataggaaaaaaaaaggtgtttcaagaaaaatatggccggaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatggacagagtcctggggggat

SEQ ID NO: 55347 - DNA, 115 bp, Homo sapiens
cactttaacttaaaaagtggtgacaactgaatatgtacaaagcgtaactgctatattaatagtaacaagtcaacgtcggttttcaggttttgcagtgggagaagctggtggaggt

SEQ ID NO: 55348 - DNA, 397 bp, Homo sapiens
tgttataattggtctgttttataagttattgctgttaacctcttactgtgcctattttataaatgaaattttgttataaatatgtatggatagggaataacatagtacacaggttttagtactatctgcaatttcaagcatccactggggggccttggaacatattcccctcatgtaaggggagtaatcgctatacataatactagctacttactcactaacgtgatgggcttaaaacaaatacactttaaaagtaagatttagctgggtgtggtggctcatgcctgtaatcccaacactttgggaggccaaggtgggcaaactgcttgagccccagagttcaaaaccagcctggccaatgtggcaaaaccctgtctatactaaaaatacaaaaatt

SEQ ID NO: 55349 - DNA, 921 bp, Homo sapiens
caggggctcatgcctataatcccagcactttgggagggcaggagttcactcacgaggtcaggagtgggggaccagtctggccaacatggtgaaaccccgtctctactaaaaatacaaaaattacctgggcatggtggtgggtgtctgtaatcccagttactcgggaggctgaggcaggagatgaagaattcaacttttgttttttagacagttgtggcaagagtgttaaggaactaaaaaggctgacagaccaacaaagaggttattacataatccagtggtaatgccatcttcaattacagcaatacaagacagagtggtaaaaagatactgggtataatcaacaggttaaatgtgttgcggagagaagacagagaattttggaaaacagattccagagacctgacaaaatttgttctttagccctagcagaaagagaatggacttgggggttcaaagatctggggtcccaaatttcatcttaatctctcaagaaactaggtatatcacttaacagatataaaatcattcatttatatactttgatgggttgctgtaattgttcatatattatgtataaatctatgtaaacacacataaatatatattaaatgcctgtaacatataaacatatgtaaaatgcctgtcacgtagaggcggaggttgcagtgagccaagatggcgccactgccctccagcctgggcaacaagaacaaaactccatcttggaaaacaaacaaacaaaaaaaactgttaagctcttcctctacactcatcctctcccctctcaacatatcagtcaagccaggcgccatggcttgtgtctgtaatcccagctacttgggaagctgaggcaggagaatcacctgaggcaaggatttaagaccaacctgggcaacaaagcaagagccccgtctttaa

SEQ ID NO: 55350 - DNA, 792 bp, Homo sapiens
tgggagttgggactatatccagttatcaaagagccagtttttaagcaggagatgaagaattcaacttttgttttttagacagttgtggcaagagtgttaaggaactaaaaaggctgacagaccaacaaagaggttattacataatccagtggtaatgccatcttcaattacagcaatacaagacagagtggtaaaaagatactgggtataatcaacaggttaaatgtgttgcggagagaagacagagaattttggaaaacagattccagagacctgacaaaatttgttctttagccctagcagaaagagaatggacttgggggttcaaagatctggggtcccaaatttcatcttaatctctcaagaaactaggtatatcacttaacagatataaaatcattcatttatatactttgatgggttgctgtaattgttcatatattatgtataaatctatgtaaacacacataaatatatattaaatgcctgtaacatataaacatatgtaaaatgcctgtcacgtagaggcggaggttgcagtgagccaagatggcgccactgccctccagcctgggcaacaagaacaaaactccatcttggaaaacaaacaaacaaaaaaaactgttaagctcttcctctacactcatcctctcccctctcaacatatcagtcaagccaggcgccatggcttgtgtctgtaatcccagctacttgggaagctgaggcaggagaatcacctgaggcaaggatttaagaccaacctgggcaacaaagcaagagccccgtctttaa

SEQ ID NO: 55351 - DNA, 3079 bp, Homo sapiens
taaatttagatttttcccatggcttagctcaggcaaatgtccttcccatgcaaaatagatggtggcaggacctacaactcttcccagtcatcagtgaccctgcacctatcctcagagtcctggttacggtagcccaccccctagtcactcaccctcttttttccccgacaagaggatcacccacatgcccccatggagggttccactgtctaaaccatcaaagactgggatagaagcagtcaccaagtcccaaatacagaattagaactcaggacctatttccaatctaaacaatgaaaaaatcagagtacaagaggtcagctcagcaccagattaaatgctttttttttttttttgtctgagacagagtcttgctctaccacccagtctggagtgcagtggtgcaatctcggctcactgtagcctccgcctcccaggttcaaggattctcctgcctcagcctcccaagtagctgagattacagacgcccaccactaggtccagctaatttttgtatttttgtagaaaaggggcctcaccatgttggccaggctggtctcaaacgcctgacctcaagtaatccacctgcctcagcctcccagagtgctgtaattagagtcatgagccaccacacctggcctaaatgcactcctataagacaatgtggaaggtaggggccaaattccacacaaccagcttagaagacaaacttttacagcaaagagccatcatttggagaaggacatatgtataatggcaaagaggtattaatacgtgaagtacctgtgacattgaggatcgttacctagaattgacattcagtatttacttcacatagctctgtaactgggtctcttgtaaacaggcattttgtcctcccccttccaatactgtgaacccattattatgtcacctttcctcatgacagtcctataaactaggtaaagaacaaacgtctctattcacagacagaacaggggaaacaagataaaaaatacaactttccagtatttaacaaattctgtcaagtctagacaaaaggtatgatgtctaaatgaagctgttagtgggctatgttgaatctcaaaattatctttctccttttttttttaagagatgatctcattctgttgcccaggctggagtgcagtggctcaatcatagctcactgcagcctcgaactcctgggctcaagtgatcctcccgcctcagcttcccaaggagctgggatgtgccagcatacttggctttttttttttttttttttttgtagagatgaggtctcacaaagttgcccaggatcgtctcgagcttctggactcaattgatccttctgactcagcctcccaaagtgctaggattacaggcatgagccaccatgcctggcctcaaaattgtctttttaaatatgtctgtgcttttcatagtgtaactactatacaactgaaatgtcgattatggcacaattgatcataactgactcacatactttgtgttttgtttttcatggtgtctctcctagcccagaagcttcctaaaccacttttccagaggcttttttaggaacacacattaaaacatgcttcctgaagcagagccactcattcccgggtccccttcctcatccttcaaagagctctgactctcaactttgttttttgagctagcatggcatgcacacaaaatccaagcttatgactctacaatgagagtgctttgatttaaataatctttccttcctaatttaggccctcccaacgaaaacttaaacctttatgcttctttacagagaaaaacaagcataaggaaagcccctccatttcctacaagagacagatctccaggactgaattttaagccatggggaaattgcaaaggagacacctgagctcttttgagcacttgtgccaaaacacaacagatggaatggtttggcatttcagaatccagttccacagaataaagaagaatctccactctggcagtggggaggaggaaggaagtggaggtttgttggctttactttgccatccatccctttctctatgtggtagagaaggactgagaggagtgatcccacaggacacaggttcccccgtgtctgtcaccttcaagggggctcaggctcccagggggaaggcacaggggaatcacggagttcagttccaggctccaggactttccagaagggacccctgagcaggactcgctttcaccgtcaagtattgctttcttttttagacacaagattttgctctgttgccctggctggactgcagtgatgcaatcatagctcatcgcatctgcaaccaccagggcttaagcaatcctcccaccttagcctctggagtagtggggaccacaagcacataccaccacagccaggtaattttgttgttgtttttgtaaagacagggtctcactatgttgcctaggctggttttgcactcctggccgcaagcaatcctcctgtctcagcctcccaaagcactgaagttacaggtatatgaaccacatctggccagcaccaagtattttgacaaagcacctattagggtaattccaagtaatctctggcaaacatggtttcagttaggcaagactacaagaaaccgcccacatctattttgtaaaaatctgtgctcccctttcctacttgagtagacacgctcacaaacagacacaaaggcagacccctccctctagtttttctaacataccagagccccctgcaaacacctgaggccctcaatgctgattttcactggaatctcatcacagttgaacagggtagaagcagcttaacctctctccttgtgcctcgctggaaccagtggctcgtcttccacgggctgcccctgatccctgggctttgagggacaaagagcttgctggaaatagtgatcaccctcgtgatgacaccaggtcaacaggcagctgtgggctcattaagatgtaagccggccgggcgcggtggctcacgcctgtaatcccagcactttgggaggcctaggcgggcggatcacgaggtcaggagatcgagaccatcctgggcaactttgtgagacctcatctctac

SEQ ID NO: 55352 - DNA, 640 bp, Homo sapiens
aaaaaaaaaaatcaaagtttattctaattggaaggaaacacgtatagggaaagtataggtcaaggcaaggagctgttttgttccccttcttatgtatgaaatgtagatgtgcttttatttacacaaaaggtgtattcttgtgtatttgtgggcaaccaaattctaaatagcaaccttcaaatacattaggaaaacttactttaaaggagtctgtattaaaacttttttttaaaaaaaattatttaaagagatggggtctcattatgttacccaggctggccttaaaatttcttggggttcaagtgatcctctgccttagcctcctgaatagttggtactgcaggcacatgctatggtgccccagataaaaccttatctttggccaggtgtggtggctcatgtctgtaatccctgtagtttgcaagaccagggagggtagagtttgataccagtctgggcaacatagtgaaatccttgtttctataaaaaattacctgggcttggtggcatgtgcctgtagtcccagctacttgggacaccaaggtgggcggatcgcttgagcctgagggtttgatggtgcagtgagtgatgatcatgcccctgccctctagcctgggtgacagagtgagacactgtctca

SEQ ID NO: 55353 - DNA, 162 bp, Homo sapiens
caggggtcagtgagttaatctgggctcattcagagaatggaagttgtgtgccaagaaaactggttggatagggataggtcagggattccctcttgcattctcacacttgggggcatgcgtcattttcttttcttttcttttctttttttttttttttttgag

SEQ ID NO: 55354 - DNA, 262 bp, Homo sapiens
tagtggcctgataattatgatttctctcatttctcgctatcgagcttaatgggttccagcatgagtgtgcagtttcagaaatgaagttccacttgaattcacaagttattatctactttcattaatggaattggaaaagagggagtggaaaagagataaagaacgaggaagtaggaagagatgagtgagcaggaggaggaaggaataaaagaaaacaaaaggccaggaatagaaaataaaaatcaaccaaagagtaggaagg

SEQ ID NO: 55355 - DNA, 310 bp, Homo sapiens
gctcaagtggtcctcctgccttggtctcccaaagtgctgggactacagatgtgagccaccgtgcctgacctaacttggttcttgctaccccaaacacagttaatctagttcagtttgctttactataacctgtgtcctgcacttagcatgctcacacttgtttcttttacattggctttggaaatgctctctttctcttcacctgcttagctacagcctcctcagctccagtcccacctccttcatgaagccatctgtgattactccagccttcactaatctctccaatgcacctagcgccagtgctaga

SEQ ID NO: 55356 - DNA, 498 bp, Homo sapiens
tagagagggacatgattggacttctctttcagaaagattacattatgtggatgattgattaaaatgacaactagagtttgagagactaatcagtttcaattaatgagtgtttttaaatgaattcattaaaaattagtccagtgaaagagctggaattagtctagcattttgaaaagatttgtggtcaaatacattgaaaatggatgaaggatataaataatcctgcagttttgttttttatttcaataagggcttgcttaattttatgtacttttctccaaatgcattcaacagtcacctctcacaatgtaaaaggatgaccccgattatttctcttttctgagttgttagaaagttgtttctaattacttcgaaaactggttttctattttacaagattccaaatagtgttttaaaagttttttggacttaaaggactatattatagggatgttttcaatccagagactcattcagggtcactcattctccccacat

SEQ ID NO: 55357 - DNA, 1621 bp, Homo sapiens
agcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagtta

SEQ ID NO: 55358 - DNA, 268 bp, Homo sapiens
ccacgaggaaacattgtgtaaatcttaaaattttttaaaaacaattcttaaatacaaatctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaa

SEQ ID NO: 55359 - DNA, 1775 bp, Homo sapiens
agcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaa

SEQ ID NO: 55360 - DNA, 1918 bp, Homo sapiens
agcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaagagggaagaaaaaaaaaaaaaaagccctgcaaaatattctaaaacatggtcttcttaattttctatatggattgaccacagtcttatcttccaccattaagctgtataacaataaaatgttaatagtc

SEQ ID NO: 55361 - DNA, 1571 bp, Homo sapiens
cctgggaagttgcacttttcttgtccatgccataacccagctgtctttccctttatgagactcttaccttcatggtgagaggagtaagggtggctggctagattggttctttttttttttttttccttttttaagacggagtctcactctgtcactaggctggagtgcagtggcgcaatcaacctccaaccccctggttcaagagattctcctgcctcagcctcccaagtagctgggactacaggtgcacaccaccatgccaggctaatttttgtaattttagtagagatggggtttcatcgtgttggccaggatggtctctcctgacctcacgatccgcccacctcggcctcccaaagtgctgggattacaggtgtgagccagggcaccaggcttagatgtggctctttggggagataattttgtccagagacctttctaacgtattcatgccttgtatttgtacagcattaatctggtaattgattattttaatgtaaccttgctaaaggagtgatttctatttcctttcttaaagaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaa

SEQ ID NO: 55362 - DNA, 657 bp, Homo sapiens
agcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcagtagccacagggacctcaagagcaccaca

SEQ ID NO: 55363 - DNA, 1837 bp, Homo sapiens
agcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgttaaaaaaaaaaaaagaaaaaaaaaaaaaaaaaaaaaaaaaaaagagggaagaaaaaaaaaaaaaaagagaaaaaaaaagaaaaacaaggaaaaacaaaagaaaaacaaacaataaaaaagaaaagaagagaaggggcgggggcgcgaacaaaaatacaaccgcgagggggcgcgccagaaaagtcgttggcagagcacccaagcgctctgtgataaaaaggaggggcgccccgaataggagaagacacgagattattacaaaccagacaagcggggggggccgccaaaaaaaaaagcgcggcgga

SEQ ID NO: 55364 - DNA, 496 bp, Homo sapiens
gtgttacacctcactctcaccttaactaaagcttgcacagttaataaatctttttatcttttccttggtattttaactgtaagactgcatttaaaaggttcctaggagctcatttaccaacctcagggaaatccttttttaaaagcctttttaaagtggattttacacaggactgaacttctcctcaagttttgttctaaataattctctgacaccgcccccacccgttatgagagtgaagcacataggactgacttcaaggttaagtaagatgcattcagctgaggtgtcgataaatatcatgctcatggttttatataacctagttttggttttattctagtgaggtacagctttcagagcattacctaaaaagtaacaaatgtcaaaaaaggaagaatgacaaaatctttccatggaactctctgaaagaaaagtcaaggaaagtgataatatgatattttacgcacacacttttctattccgccttaactat

SEQ ID NO: 55365 - DNA, 346 bp, Homo sapiens
ctcactttagtttgagtcaatatctgagaaaaaaagaatggagtaaaagcacagaaagcaaaacttagcttagaaaatatttcctaattcaaaaaatgaacaagtcagattctgtaaagatatccagtgaaatcttgaagaaatattgtattgattattaattaatctgattggaaagtgatcttgggttcacaatgaggttgttgaacaagtagcattttcatacaattgcaaaccaattcaatgtttttgcatacactgtttacatttcttttcaaaatttgatttcttcttcgtgatcctagtcaaattctgccttctcagtaaatctttatcaagtttgcag

SEQ ID NO: 55366 - DNA, 374 bp, Homo sapiens
gttaaaagtacatattgaattattattgctgaatttataaaattaactgaataagttattttgttgtcttaatgacaatgtaataactaggcaaacactgacaatcctagaattggtctgtgtatatttttctgattggaggggggcatttctgaataacattaaaatgcaaaattaataagcattacaaatactctcctgtggaattagcaatattttacaaaaaataaatgtgtgtctatataaaattttgtattctttattaggaaaaacagtagggtaatcatgaatttgaaagtgccatagcacttttttctgtgaatggccaaaattatttaggaaaattattaagtgtaatttcattgtgatcaaaa

SEQ ID NO: 55367 - DNA, 526 bp, Homo sapiens
ccaccacctcttatcacaacccagacattcccttctgtgatctcaggtcttcagataaactcaaccagctgtcaaccagaaaatgtttaaattcacccacagcctggaaccccctttcctccaccccctcgcccccacccaccacttctacttgtctcttttctggaccaaaccaatgtatttctcaaatgtatttgattgctgtctcatgccttcctaaaatgtataaaaccaaactgcaccccaaccaccttgggcacatgttctcaggacctcctgagggctgtgtaatgggccatggtcagtcgtatttggctcagaataaatttcttcaaatattttacagagtttgactctttttgttgacaccttttcttagacagctactacaagatgttcttcagaaaatggatggcgcaaactgagaacaagtaagaggtggattcagaaagttaggagatccggtgtgaggagagaagtgtagttggtggccagggtgacagccatttaggttccatagacaaac

SEQ ID NO: 55368 - DNA, 459 bp, Homo sapiens
agcaaaccaaattcaacagcacgttaaaaggatcattcaccttgatcaagtgagatttatcccggcaatgcaaggatggttcaacatcaacacacttattgcaaatcaataaatgtgatataccacattaacagaatgaagggggaacaaccccacacaatcatctcaatagatgcagaaaaaaggctaagtatagtggctcatgcctgtcatcccagcattttgggaggctggggtgggaggatggcttgaattcaagagctcaagactagcctgggcaacacagcaagataccgtctctacaaaaacagctgggcatgatgcacatgcctatattcccaagtactcagggatgctaaggtagaaaggtcccttgagcccaagagtttaggtctgcagtgagccatgattgcaccactgcactccaatcaggctgacaagaatgcaacagtgtcttaa

SEQ ID NO: 55369 - DNA, 518 bp, Homo sapiens
tgcgtggatatgtgtctagcacagtgaaagatgctaagacaggcctgggaaacatatgatttatctgtttaaacatatattccgccccccccttttttttttctgagactaggtcttgctctgttgcccagtacagtggcgtgatcactgttcactgcagcctcaacttcctgggctccagcagtcctcccatccactaacacatttcttgttctccagtcctcttacacagtaactgccttggtttatcctcattcagcacaactaaaggctggatttcttattcatgatgtttcttcctcctcctatccccaagtaggcacttagttgactgattacagaatcacaaagttggttataattccatttcttcatctgactttgaacttaagtgttccaattactttgcctgatcctaataagtcagtagcgtgctaatgcttgccttgatatttctgaaatatacagggttgtgattagcatgggattgcatcattagaaagctaagttgaaagtgg

SEQ ID NO: 55370 - DNA, 281 bp, Homo sapiens
ctgacacctaatggagaaaagcatggagttcatgtagattattaaggaaagcagatagacagatgcaaagcttagagaagaatattaaatgatttatgtgataggcatatgcaattgtgcagtaggttagcagaattatctgagcttccatactcatagccttcatgatctgtctcaattttacctccaaaatgagtattttaaccatttttttcttctccaatttctccaatcactactcttctattggcctaaatggtcccatcttaaatcaacccacc

SEQ ID NO: 55371 - DNA, 295 bp, Homo sapiens
gaaaaaagagaaagttttcaaatgcctgggggagatcctcttattcttaggcaagtggttcttccaccagagagaaaagtttaattactgcctgatggagctgaaccccttgggtggggaagggaaaggctgcagtggcttctggatgggaaccagccacccggctgtgtgagactcttgagccatgtgtcccagccccagcatggaggggagggggagcaaggagcccctgctcccctgtcctgaaaaaggaaggaaagggcctttcccccaaccccagggagccacagggttt

SEQ ID NO: 55372 - DNA, 296 bp, Homo sapiens
atactgcgtgatcctatacttaaaatatataaccaagtcaaactaatcagtgctgttagaagtcatgataatagttattcttggactactgattggaagcaggaaatttctgaggtgctggaatgctttatctttttatcttgttgctggtttaaatttgagtttgcaaaaattgattaagccatgcacttattacatatggtatttattggagtatattatacctttattaacagttaaggttgaaaaaattatttagaagattcctatcccacaaaatcactatctacattatt

SEQ ID NO: 55373 - DNA, 3777 bp, Homo sapiens
  misc_feature (1)..(2): n is a, c, g, or t
  misc_feature (5)..(5): n is a, c, g, or t
  misc_feature (7)..(8): n is a, c, g, or t
nncangnncttcagcatgactactcagttgccagcttacgtggcaattttgcttttctatgtctcaagagccagctgccaggacactttcattgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagaaaacacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctcttttagttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttaaagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaata

SEQ ID NO: 55374 - DNA, 3723 bp, Homo sapiens
  misc_feature (1)..(2): n is a, c, g, or t
  misc_feature (5)..(5): n is a, c, g, or t
  misc_feature (7)..(8): n is a, c, g, or t
nncangnncttcagcatgactactcagttgccagcttacgtggcaattttgcttttctatgtctcaagagccagctgccaggacactttcattgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagaaaacacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctcttttagttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttaaagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaata

SEQ ID NO: 55375 - DNA, 595 bp, Homo sapiens
gtaaattagaagacattgattacgggcatctcactaataaatgaatcagtgccagtttcatagctccaatttttcttgtacttggcaacatttcaaatttttctgatagaatggaatttggccagtatttttgtttcttcattctgttatagtaaattttaaaagtgatttatgggattgtaaaacttgaaggtagcctttgcctacttttttgttttaatcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaa

SEQ ID NO: 55376 - DNA, 3845 bp, Homo sapiens
  misc_feature (1)..(2): n is a, c, g, or t
  misc_feature (5)..(5): n is a, c, g, or t
  misc_feature (7)..(8): n is a, c, g, or t
nncangnncttcagcatgactactcagttgccagcttacgtggcaattttgcttttctatgtctcaagagccagctgccaggacactttcattgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagaaaacaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctcttttagttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttaaagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaata

SEQ ID NO: 55377 - DNA, 2777 bp, Homo sapiens
ccacctgcaaagtggaaacaataagaccagttagcggctgctgctttagtcaagcaagagatgaaggtgacttggaatatgctgtacagatggcattaaatgaatatggatctccttttggaaacttttcatctgcatgatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctcttttagttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttaaagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaata

SEQ ID NO: 55378 - DNA, 782 bp, Homo sapiens
aaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaacctttaacctttttt

SEQ ID NO: 55379 - DNA, 402 bp, Homo sapiens
caaagagtttttaacagggcaataagtggccttattagtgatatgctttaaacatttttgcacaggcatctgcactgattggttttccttttcttcttctctgcagacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtct

SEQ ID NO: 55380 - DNA, 787 bp, Homo sapiens
gaaagatattttcagacaagtaaacagatattctaaaggatatactttaggaagaaatataatcccagatggaaggtctgacataaaagaaaacatagacgagcgcagatattgataaatacatgggaaatctgaacacttccagtgtaaaacaagaatattattttaagtgggtataaataaataagatagaaaataccggccaacatataacatacgttaggaggagtgattcatagttcaggtatgctaagattcttacatgatttggaagaagggtgtgggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaacctttaacctttttt

SEQ ID NO: 55381 - DNA, 200 bp, Homo sapiens
cttctgtctcacatctgtttacatctaacacattagtagaatcccaaagcattagtatccatataccagatcagaaatccaaacccagcactcattaccactagctgcatataacattttcataattattaagttgccattctagaagagaagaaatataatttgtatacatacaaatgtgtgtgcgtgtgtgtgtgagt

SEQ ID NO: 55382 - DNA, 692 bp, Homo sapiens
tgggaggtcgagcgtgcagtgagctgagattacaccactgcactccagcctggataacagagtgagaccctgtctagaaaaaaaaaaaaaagttatagaaaaatgtttcttgaaatggagaaatatttgccatgtgtattgctacttgaaaaaacatcatcagtatatacatggttttatatttaaactttttctaggtatgtgtataagtatcaaaaatagactaaaaagatcatagacattattggttactgcctgaatattcctctcccatctccaatcccacacccatattatgtcctctcttgctggcagaatgcttatccttggctcagccatgtgctcatagaagttgactctatgcctaactcagaaggtaaatttgattagtctaatccaaatgttgtaggtcaatttccccttagtagtgattggtttagatgtagacacatgatatatgggagaatcttctggtaaagaaatgaacagtcctctttctgtgaatactgcatcttgatataatgtctggaactgcaacagccgtcttaaaccttgagggtggcagagaagggagatggaaagacggatccttgatgactttggtgaactactgaattaaccaatcctggaatggcccatcactgactctttgtaatatgatataataaaatgttccattgtttgaaccaatt

SEQ ID NO: 55383 - DNA, 265 bp, Homo sapiens
ttggtttaatacatatgtatttcaggttgatggttgatttcattagcaaatctcattgttatgcaatgtctgttcttctgcagaaaaatgaatattgtattctcacagcctctgtgtgtatctattatgttgcaataaatgaaaatatacacatctgtatctgtctttggcttactctttccattttgtttttaaggaaaagaaagaaaattgaataatattcttttgttgttaaatttgttcaaaagccatttcaatttatatt

SEQ ID NO: 55384 - DNA, 320 bp, Homo sapiens
ctgtgcaatatttgaagtagcatatgcttatactaaaaattattcatcatctgaaattaaatttaactgggtgtcctgtatttatctggtgaccctaccacagggaaagttttacctttacccttttgaaggtggggcaggatttgagaaggggacttggggtgaaagaccccttcatattaccttctcagcgccagactgatgccaggaaggccagactcatgcctgcggtgcagtgattatttgatgggtcagaagacccctcagtgcaggacatagagagcccccgttcaccagttgttaagctgcaccccacagcc

SEQ ID NO: 55385 - DNA, 655 bp, Homo sapiens
agttaaaaagaaaattgtactacaagggttatacaggttgagcatcccaaatctgaaaatctgaaatccaaaatgctccaaaatattaaactttttgagtgccagcatgactctcaaagaaaatgttcattggagcagtttgagttttaaatatttggatttgggatgcccaactggcaatgcaagtcttccaaaatctgacaaaatctgaaattcaacaaaatttgaaatctgaatttttctggccccaagccaggtactcagataacctgtaattaaaactccggtcctctgcctcatgtctttatgactttccctcctgtgtcctgctttcagagcaaccataggtgtttcttctatttatttacatatttaaaaattatatacttttactgtttgtttttcagttttattatttatttatttattttttgagacagagtattgctctatcgcccaggctgaagtgcagtggtgcgatcttggctcattgcagcctccacctcttgggttcaactgattctcctgcctcagcttcccaggtagctgggactaaaggtgcatgccagccaaatgatttttgataaagatgcataggcaattcaatggagaaaagagaatgaatggtttttaaacaactggacatttataagaa

SEQ ID NO: 55386 - DNA, 285 bp, Homo sapiens
gaaatatcaaacatctgaggagcttataattagttaagcatttacgtgtattaatatatcgtcatgtggacagttgagaggggagaaggcactagacaaatttaaaattgttagaaaccattggcaactgatattcagagcctaagttaaaagcaggatatgtctcaggagcaaatcttttgtgtaaatcctggtatttttactgcagacctttaaaatgacagacgcgggtgagtaaaaattacttctggaaatggatatgattaattaattcaattaattaat

SEQ ID NO: 55387 - DNA, 230 bp, Homo sapiens
cccaccttcctgaactgtctcttgctcctgtttgatactgtcatgctgcacgaagcttacacttgctatctctcacttccctcttagtcatctgtgatgctggctaagggagctaggccagtcagcagtgacctgttgcccttggtttattataagcaaactgttcacaagaaatgaacttctgttgttttataaatgatatgcatcacagaacacagaataatatcaaa

SEQ ID NO: 55388 - DNA, 458 bp, Homo sapiens
cagccaccgtgccataaggaaactcaagccatgttgtccatgttgaaattgacagccatgtgattgagtcatcttggaggtggttctttcaacatttgatgagccatcccagctaaccccaagtgcagaaaaataagctatccccactgaaccctacccaaattgcagatctgtgatagaaataaatgacttgtttcttaagccattaagtgtcagggtggcttgtaacatagcaatagataactggaacacttagcaaatcatagagctcacatttaaacacaggcattctgactccagagttcatatttatagttgatacagaatgcttcactgtccagatccctattcgagactgaaattcctgatcatcacctcaaatgctgcaagtgtcgccattcaacggctctcagttctcaggcttctacaccaattgctcttgggtgaagagagaactt

SEQ ID NO: 55389 - DNA, 637 bp, Homo sapiens
gtgtgagaacattgttctctgcagtggtctttatagggtctttagacaattcgtggtcacttttctggatcccttgcattttctagctgcattttcctcaactgggtttgggaaaaattaggtctggagtttgggatggggagctgtttttactttacaggtgaggtaactccatacgtgttgaagttttataggagtatgagtggaaccaacctctgatttttggctcagtactgacccttggactggagagtcctgttgtcagcaacaagaacacagtttaatgagaagcaattaagagtgcggtctccaaaccatagtcttaatttcagattcttgcttctccacttactgcctactaaaccttaagcaagtaactggaatatctctcataacataccataggattaattaatgctgtagttaaaagaaaaacaacaccagctatgtaattgtataaaagacttaataaaatgtggatgatttaggctgggaagccgttaactaaccattcatcataaaagggaggaagcaagaggacccacttgagtaggctgggacaaattgctgtggttcagttttactttttgcttttgtttctaattggagctgttttgagacatcctgattgtcagag

SEQ ID NO: 55390 - DNA, 318 bp, Homo sapiens
tagttactctgggcttcgatttgtagggactaaggctgttttctgctcaaagattctatggtatatgaattaaccatcatagcttattaaagacatgcttaaaagggggttaaaaaattatctcagcagtgacaagtaatatttgaaatttgttcatttagaaactgaatgaacagattccttccagaagcactaagattcatcatacacggtaaatatttgtttggacaaattttaaattgaggatcatttgattgatagataattgtttccaacgtcagctgaatatgctcaactgtcgctgccaattctcgagta

SEQ ID NO: 55391 - DNA, 506 bp, Homo sapiens
taacagctcactcagcatgaataagaaatgctacatggattcttttaacactgacttctaaagagcctgagaaataaacaagatgttagtttgaaagagttcatttctaattgttatttcttttttattgtttggccccatgagctgctctaaacaaaatatggtgatgttagaaccaaaaggaaagtgtccttagaataatatctacaaagaggcattcaagttttcactgcctttccttctttttctgcccttctctcagtttgggcaaattatatgagttgaatgtatctgatagaaacaactctttaaagaggggtcgggcacggtggctcacgcctataatcccagcactgtgggagaccaaggcaggtggatcacttgaggtcaggagttcaagaccagcctggccaacatggtgaaaccctgtctctactaaaaatacaaaaattagctgggtgtggtggcacacacctgtagtcccagctactggggagcctgtggca

SEQ ID NO: 55392 - DNA, 341 bp, Homo sapiens
atagattaatgtccagctgaagcatggacataaaaaggaattagaaaactacgccaaacaaatcatgagagacacatgggacatggtaaaaagatctgtggtaagtgtatttagagttccagaaaatgagtgggggatggaggctgggaggagagagagaagtaatgtttgaagagataatgtctgaaaacatgtaccataaaaacattaacccaaaaaaagctagggtaactatactgttaccatctaagttagactttgaggcaaggatcattactggacataaagagggaatgatagctatactaaatatgtaggtaactaatagattactacaaagc

SEQ ID NO: 55393 - DNA, 351 bp, Homo sapiens
gtattttgagtagagaggagagttcgccatgttgcccaggctggtctcgaactcctgagctcaagcgatctgcccacctcgacctcccaaagtgttgcgattacaggcgtgagccactgtgccaggttttaaatcatactttaaataaattatactttaaaatgctttacttctcaagattgaagataacccagatcaaacttcaggaaatgggacaatttttataaaatttcatgtgatacaaatttagaggatggattttgttactgctttttctgaaaacaaaaacttctttttttatgcttcttttttttttaatgggagattctaaattcagagaacaaaattttt

SEQ ID NO: 55394 - DNA, 3707 bp, Homo sapiens
  misc_feature (3703)..(3704): n is a, c, g, or t
tatatgtagatagttttatttttatataaatgggatcatgttatatctgttctacagcttcctttatttacttactatctcctagtttttcatgtcagtacatttagctttgttaacaaacacgtaatactccatagtttgagtgtgtcataatttaaatattccctattgaggggatttgaactgcttcccgtttggggtttttattattacagcaatgctataccaaacatctttgcatatgcctttgtgtactgctcaagaatgtctctaggctagatgtctagagatacagtcaatggatcaaaaaataggtgtggaagctgggccagtgacaagtgcctataatcccagctaatcccagctacctgtgaggctgagacaagaagattgctttgaggccaagagttagagaccagcctgagcaacatagcgagacctcatctctaaaaaaaagttttttaaaaaattagtcagtcgtggtggtgagtgcttgtagtcccagctactcaggaggctgaggcaggaagattgctagagcccaggcatttggaggctgcagtgagcaatgattgtgcatgtgaatagccactgtactttagcctgggtgacataatgagacccccgtctcaaaaaagaaaagatggatgtgttcaaaattttatattactcaaaatttacaatctaagtgaacactttatttccctttcttttgcagagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaagtacataatccccaaaagatatttaggctatgattattcttatctgggatcaggactctagattggtggtgagtcagtggaatatagcatcgttgaggtttagggactggaagagggttggatgaggctgtccaatataagcgtgaggaataagaagagaagttctaagaagcaatcatagttagaaagctgaacctaattaagcccaaccagcaagggccagttagtttaggggcaaagtctgagacacctcaatgacagagaattggctagactacataagaacacagtggatcacatttctcaatattctcatttttaatgtggtaaatataattgacattatagtttggagcatgctgctacctcaacaatatcaatacagcctgtggcgagaggaagagaaccaaggttaaataaagatcttctcgctagggaggcagcaaatgggggaaaactaaagaacctacagagatacgccccagggaggacaacctgtgcccaagaccatgttcacaaagcagttcaggcaattactgaaaccgagagatcaatccagtgttctggtcatgccaaaaatatcctggataatggatactgttctgcctggcaattatacttcattccaggtcccactagatgacaggaataaggccatttccattctcccatctcctcggaaggctggctcaggcgggacctggggtggctgggcctgcagatagatgggcccatctatcagtctaatcagccacactgaggttgggaaagctgggtcctcaaagaccagctccaaagagaaatgaccaaagtatatcttctttaggggtgggaatttgtacccatctttctcattgaacagaatactggtagtggtagtggctacagagatcattgagggttgaagaatggattgaacatgacgtttaccaaagcccttctcataagttttgacacgactcactggggttaccgcctcctttgagagctctttcttggccattggcagtatatttgagtttttatatatgttccttttcttcagctgtaatagaactctttatgaccattgtttctttaggacaggggagggctttttggaggtgttactacacaggattaaggcttcccaagaccctttctgtctagggatggccgtcaagtctcttcctctctcccccatttcaacctagtgcccagaatgtctttgccaacttaacttgattttaatctgtcttttctttgtgtaaaatattcttcccagaacctcctttccacctcttttgtccaaggctgatagtaccaatttctccctgtcctatcctctggacttcacttatctgttttccctacttaaggcagctagcaactttatatagaagctagtgtatagctaacattattaagccctgcctctgtgccaagcactaacttcatttcttgcattatcccattttatcttcacataacactatgaggcagatactgttaccatatgtcattgaatctaagatgctatcaattgtaaggtacaccactattttatgtaccagtaagaaagaaaacaggctaggtgcagtggcttactcctgtaatgccagcattctgggaggcaaaggtgggaggatccgttgaagccaggaattaatgacagcctgtgtacatagacctgtctctacaaaaaataaaaataaaaaattagccaggcacagtggtatgcacctgtagtctcagctactcaggaggccgaggcaagaggatcacttgcacccaggagttcaaggttgcagtgagctgtgatggagccactgcacttcagcctgggcaacagagtgagaccctatctctaaaaaaatgtttttaataataaagatttttttttaaaaaaaagaaagaagacattgcccgttaaacattacacagctctttcttgtcacttagaagtagtattttacctgtatcgagagagctcttttaggttagagtagtaagtaaggacttagagtgcctgcctggccaatggcaattgtaagacacatacagagatgaaaaaaaatgtgtcttagaatcaattaaatacaatattacccccattttccatatgagaaaactgagacttagagaaattaagcacactttcccagggctgcacagaaaattagtagcagagctaggatttgaagccaggcaacagggcccactcttaacccttaggatcagaaatctatattttgtacacttgacactctcagcccagacaatgtcaataaacccaggtctatcttcctccagaacctgggcctttatctactatattaacctgcctcatgctaagcaattctgaacaaaggggctagagattcacttctttcattaggagggctggtgccctcagaggccaggaactcctgtaaccagcctttcttccactatcacatggcatttgcccatggtgctaatcagaatttctctagcttcccctctgtctttccaaagctttcagcaccaggatcagagccagaatatttaactccatctataatcattttttcagaaatctgtaggtcttcgggatgcacagtggaacttatatccagactgcagtcagcttttctgctggggaggtcttcactggaatccagatgtttaggcacagctggaatgaggtctggggaaattaggcctcttctagggtggatgtgacccacctgagattttaaacacaataaagattatgctggcattattattttaaaaattgatgtattgccacacatgtagatttctggagtatggctcactacaaaaaannaaa

SEQ ID NO: 55395 - DNA, 1352 bp, Homo sapiens
agcgggccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctggtgagtacccatgtccccaggtgaaaaagaagaatcgtttttaaagtaccaaccacagaaaagcagctaactaactctgcccaatcctaaatctgcctcaaccctcaagaagacagaaaaaactggaaatactctgaaatttggagtaaatatgacttgccttttgttggtttcatgc

SEQ ID NO: 55396 - DNA, 1431 bp, Homo sapiens
agtctgggcccggagcttcctccgcggggcccccaggcccgagggccgggctgctgatccgccaggcacggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtca

SEQ ID NO: 55397 - DNA, 1406 bp, Homo sapiens
agtctgggcccggagcttcctccgcggggcccccaggcccgagggccgggctgctgatccgccaggcacggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggaggca

SEQ ID NO: 55398 - DNA, 321 bp, Homo sapiens
agagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgct

SEQ ID NO: 55399 - DNA, 379 bp, Homo sapiens
aaaggtctagcattaagccatgctactctgctttgattactatagctttgtagtaaattgaaatcagaaagtgtgagccttccaactttattcttccttttcaagattattttggcaatcctggccaaaataatccaaaatttaacttttcatgctattttatctgaaattactttcttcaaggtcacttataatctttggcccaattcagttataccccacccctaattttttagtcctttttcagttttctagaaaactatctcgtttcccactttctggtcctctttttgatattttgccctcataatatttctttttattttccagcaggtagtgagcacttctcatcttctaagcaccctgttaatctctggaa

SEQ ID NO: 55400 - DNA, 351 bp, Homo sapiens
tcttgttttattatgttttcctagttcattttttttttttacacaaggacaattttaatcttgcattttcctgtagtaacatccactgctggctatctatggattgaaactgcatttgctaagaactgtgaacatgaagaaactttacatgaagtcacatgttgatgcaggcacacagacatcttccagcaccaacagaatacatgcgtaacacataccagatagtctcgatggataagtttgcttcaccagtaattctagttagtaagattcacagttaatgcagaatcggagcttgcagtgagccgagatcacaccactgcactctaccctgggcgacagagcgagact

SEQ ID NO: 55401 - DNA, 504 bp, Homo sapiens
aaattgtgttaaaaaataaaactccttttaatttcataaggaagtgattccaaatcacacttctagaatgaataggaattagagggaatgttatggaatcaactcatatgagaaagattcagcctcaaagattctgagaatatctgccttaaccagttgagaaagaaggtagactgtttccttttttagtctttgctctttcacaaccatggcagtaggggaattgtttaacttgtgaaatgccttttatacaatctgcttgggaaggcattttgtttataatgtgataactgtgccagctttcagaattcctttcttttgtttttaaggtctaacatgaaacactgaatgttccctgtcttcacagcctgttctccctcctcccgctgcccctgcctgctttttccctgcctccaatcccatagtcagctatcagaacaacagattacaagtaaacatctatttattgagcactcatggaataaagggttttttttctaagtt

SEQ ID NO: 55402 - DNA, 257 bp, Homo sapiens
actgcaataccagctcttcattggctcttcagcccaccagcccaccctgcagattttgaacttgtcaagactccacaatcatgtctaacatgaaacactgaatgttccctgtcttcacagcctgttctccctcctcccgctgcccctgcctgctttttccctgcctccaatcccatagtcagctatcagaacaacagattacaagtaaacatctatttattgagcactcatggaataaagggttttttttctaagtt

SEQ ID NO: 55403 - DNA, 335 bp, Homo sapiens
  misc_feature (31)..(31): n is a, c, g, or t
acattttgcaaactcagttgactcacctcanatttgccattccaattacagggcctcgaaagagtcagcactcagccttgctcaaggatcagatttaggggttgccccccgcccccgcaacctcccacctattgtttcaaatgtcctcaagacaatcaccactgtattaagagaaagaggcatgggggcagagcaacaaggaaataaatgaggcttgagaactgtgtctaggtggggttactttgaaccttaaaccacccttgggccccaaatctgcatgagcaggggtgggctatcatgctacagcacccccaaggaggacattgttcccaaca

SEQ ID NO: 55404 - DNA, 550 bp, Homo sapiens
gcccctcaccccaatacccagcctagtagcagtactttggttcccccagggagctcctcttttaaagaaaagggacaggacccaattgttactgagcccctattgtcatagtagccaccatttattgatggttgactatgcacctgccagatactgtacccttaacagcatttatcatccaaccctcctttagcctgctgagggggttatacataataaggaatattgtacatactgaggaacctgagactccatgaggttaaaacttgcctaaaataacacagctagggaaaaggcaagctggattttgaactagggctctaagtgctgagcctgtgggcttcataattggaccaaatccctgtgtgctgggcacgtgtccagcacttccctcatatgatctttatgtgaaccatcctctggaatcctcagaacaaacccaggaagtaggtatactcatccccattttacagatgaggaaacaggcacagagagatgactggcttggccaagttaagaataatggctaacaaacaaaaacaaaaacaaa

SEQ ID NO: 55405 - DNA, 395 bp, Homo sapiens
ggatcttggaagatgagtagacatctgccaggtagagaagagatggtgggagccttctagacagaacaagaatccaaatgaattctagtgactcttgccgtaacactatggtcattacgtgggttcggatacacggaggctcaagtcatatgacttaggatgtgactaaggcattccaccatccaatccaactcaaccagtctgcagaggcagggcttaccctgggccccagcacgagctttgtgctaagcagaaagaggaatcgtttttggtttctgagtgctgctgtacttcagtttacaaatcccagcctccccatggctactttatctatagccatggcctgaccaagccaagtggaggagggggatacaaggatgcaaggggcacccagg

SEQ ID NO: 55406 - DNA, 427 bp, Homo sapiens
taatttaataggtctcccttttcggcaatattttcattttaaaaagaaaacttctgttagagggcaagtaattccaaagaaattagattctgctggttgaaacgttaagaatccaggcaggcggtgagggaaattcgtttcccggcttctccaatctaatctgatagtgcccgtcttgcctcagtcgttaatacttcttgggaaaaagcatatgtgatcactcttttaaaaactgttagaatcactttcctatccaaggtctgaaagaagatttgggcttaggctccatttgaagaaatccaggttgtatttcccccagcatttagggtttgatggtttctgcttatctaaagtgctcacattgcaaatatgagcagcagggctggggatttaaattctgtcttgatgggaatttgaactgaaatgc

SEQ ID NO: 55407 - DNA, 346 bp, Homo sapiens
atcaacgtcacaatgaaagattcagtgtgcatgcctggttcacacacgagcatgtgcagtgatgaaagccacagccctcaggatggaagacggttctaaggctggagaactgccggcaccacgtctactggaagccactggacatgcatgaagtaactctgacccagatcccacctccaggagccgccctgcccgccacacttgggcacaagcagtcccagggtccacactgcaggctgcaggccagggtcctgagggccctaaaggcacaccaatggggctgggtaaaccacttcagacagtggggtgtcctgtagccataaccttcaagaagtcctgccctact

SEQ ID NO: 55408 - DNA, 434 bp, Homo sapiens
gcaaagtgctaaaatctgaagaaaggaagagcagttcataaatgcttatcttcacattgttcattgggctgccctaacctcccctgctcccagagaatgccagatggctttacaattgaggtggttcaaacacagaaggccctttttccttttattaattgctcagctatgtgtacattggcccccacacctgccacctgaccagcgcggcttctgcctccctcagcactgccagccgggggttttcttagactcatcccctgggccaccttccgctcctctccctccctctgcattaacatccaggccaccctcattactccttggcaacctagcttgggttggcctccccagccagccttccagactattctttctctcccttgcagcctgtcttgcacaccactgtggccaggtcagtctttctgagaata

SEQ ID NO: 55409 - DNA, 289 bp, Homo sapiens
cccgcccccgtcagccagagacccttttcctttaacttcttaggtcaatgtgaagtcaacgtctaatggacccgagttcagccaagaacacacaccagttgttccagggaagaatctcatggtgaagcactagtgagcgtccaagcaactcccagcctaacctcaccggtctgactgtggggctgcttctgccacggctcctggctggcgatggggctgtcagcgtgtcagccaaccatgcattgcagatgcactttgaagaaaattaatgtacctgggtacttatggg

SEQ ID NO: 55410 - DNA, 1523 bp, Homo sapiens
  misc_feature (638)..(638): n is a, c, g, or t
ccccttgaagagcacacacagatctcttcctgtcagaatggagacttagattgtccttctcagtagacaaatttctcagcagaaatctgaccccaagattgggcgtgtgcttggcctccggggcctgtgtcccctccaggctgactagggctctggtggcgtgacgtaccgctgtgctcccgcggtttctcagccacattctgaatcttgaggaacagagctgcaaaggaagtctctaacctatctcaccattttatcaatgagggagctgaggacccctgagggaaagggccttccctcgggctacacagggaaaggtgcacaaagccaggcttgacccggggtgctccatgggtcagacaaactccagccaccgaaactctgctccagcctgatgtgtgcgctgggcctggcgaggtcgcttggcaaagccctttgctgtggagcttcctcttctccagccaggccttttcttttctgatgatcagttcgtctcccatcttttttcttgatccttaaatttgggtggcatttctggtgtgaaaaggggaacgtgtgaaatgacggtcacatcctttgggtctagttcatgagaaagatcaggaaaatgaaaaatctgccatttcctgctctgagcncaggctcctgggagtcacccactaagtccttctaaactgcccaggtctcgggatcctgcagcatttccaagggccaaatccacactcaggtccctcacacccacttccttgcttctgagagatgtgggagcacaggcacactcaacaaggacccgtgcccaactcctgaggagttcaggggcaaggtgcccaaacacaggaggcccccagatcccaagggaaggcaattctggagccctgttgggcagcatgttggagtgtgggcctgatccccgggcctcggggatcacagcgtgtgctgtgtgttagtaaatgcttctgcttccttctagactaaagctttgattgataagctccaaaagcttgtgtcatctgagggcagatttaagaatctcagagaagctctgaaaaagtaagtgtgtgtcgttttgtcgctgttatttttaaaatcatagacctgcattgcagaggcattcacgtgccgcccccagccagagcaggaggtctttctgtctgtctgttcgtctgtctacccacaagacccctagatttcctggaccccaatggtggagtcctccatggtctgccagagaaactccagagtttgctagcatttcctgagagaagcacaggaatactgctgggatccctgaaagcatagtagctgtgatgataatagtagtggtgccagatttctcgattctaaaatgcacgttttcttttcacattttaataattctgacatcaggagacgtcttaacgtcagttttgtttatttaacacaattgtgtttcctttttcactccagaattcatcatcaaaatgtttgcattttataaacaatggcatccgggaattaaaaaaatacagttttacaataatcat

SEQ ID NO: 55411 - DNA, 4257 bp, Homo sapiens
  misc_feature (1385)..(1385): n is a, c, g, or t
  misc_feature (1447)..(1448): n is a, c, g, or t
  misc_feature (1909)..(1909): n is a, c, g, or t
cggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagactacgaggccaagcctgactgcgaggagaggacgntggagaccttcctcacctaccccatgttccagatccccaggtacatcctgaccctccatganntcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggatttnaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55412 - DNA, 3361 bp, Homo sapiens
  misc_feature (489)..(489): n is a, c, g, or t
  misc_feature (551)..(552): n is a, c, g, or t
  misc_feature (1013)..(1013): n is a, c, g, or t
gtgtcagaactcctctatgaaaaggaatggtcaactctgtgagttgaatgccgacatcacaaagatgtttctgagaatgcttctgcctagtttttatgtgaaaatattccgtttccaacgaaagcctcaaagctgtccaagtattcccttgtagatcctacaaagagagtgtttcataactgatctatgaataagaaacgttaaactctgtgagtagaggacacacatcacaaagaagtttcttagcacgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagactacgaggccaagcctgactgcgaggagaggacgntggagaccttcctcacctaccccatgttccagatccccaggtacatcctgaccctccatganntcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggatttnaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55413 - DNA, 690 bp, Homo sapiens
gtggggagctgccccctccgtgcattcaccaacttgtccgtccgtccgcccccggggcaccactccatccacctcctcacatggctggcttcctcgtctgccgccgccaccaccgctgcctccactgcctctggggccccccattctgtctgagtccccaccctgaccgtcttccctctttcaggtggcctgtgggcccgtttgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55414 - DNA, 2861 bp, Homo sapiens
attcggggtcctttttggcctacttggggtgagtcaacataaggagtgcaggccaccttagcctttgcttctcaaaagtcatgggtcaatgaagtccttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaaacaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55415 - DNA, 4296 bp, Homo sapiens
  misc_feature (1385)..(1385): n is a, c, g, or t
  misc_feature (1447)..(1448): n is a, c, g, or t
  misc_feature (1909)..(1909): n is a, c, g, or t
cggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagactacgaggccaagcctgactgcgaggagaggacgntggagaccttcctcacctaccccatgttccagatccccaggtacatcctgaccctccatganntcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggatttnaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagaggaccagggaggggaccagggaagcagaaatgagcaggtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55416 - DNA, 1624 bp, Homo sapiens
ccaggcctggctctccagtgtccgcagcctccgttggtactcaccagctgtggctctgagcccatcactgtgagcgtgcgcactttggcctgactttgaggctctaccctcattccccaccgtgtgtaccactctcctctgctctcccaattccatccttgcagtccctcctctgggcctgtggctgccatgctgctgcctccccactccctgtgcttccttcctgtcatgcatcctgtcatccatgtgctcgcaggagcgcctgctaaatgtccagtcctgtgctggcaccagagctatggggctgaatcagacaccgtccctccctcgagggctccctgcctgaggtggcagaaaggccattcccacccagccagatgcaggaagcccaggggctgagagggccccagaaggggacctcccacagccaggagcgccaggaccatcaggaagaagagtgaaggaggaaggggaaagggtgctcctggcaatggggatgacgaggacagaggggcgtaagagcagaggccgtgtggggctgtccgagctggggaggggctgctgcaacgtgaagtggggctcaccgtgccttctcgctcctgcctaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55417 - DNA, 1138 bp, Homo sapiens
ctcagaactgcctgctgggacaggagccctgccttctgcctccatgtgggctggtcagaggcccgggaggtgaagagcgcccttgtcaaggacagccccaagtaggagtgctggggtagaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaattc

SEQ ID NO: 55418 - DNA, 374 bp, Homo sapiens
ggtcatatgttacatgcatgtttgttcaatatgtgtatgtcaggaccatcttcacaaattttcatagccccttctgtgatctgttaaataggtatatttagccaaccctctcagcataaagctcctaccccagctgctcccccttccaagtgcctgcatctgctcttggctgggagctcgcttcccagcctgtaggatggccaccttgaaggctgtaaccctttagaagaaataaagtctccttttctaaatttatagattgtatgattgttttaagctaacaatagcaatggcattatcacctcactttctgtgtgtgtgcttagcatagtacctgacacatggcacttgagttggtagctattttttaatat

SEQ ID NO: 55419 - DNA, 216 bp, Homo sapiens
  misc_feature (211)..(211): n is a, c, g, or t
  misc_feature (214)..(216): n is a, c, g, or t
ggcaaataacataagaggactaaggacagccaagcatacaatgatgcatggcagtgacagctgacctcaacgtggggaagacacaggggttgttgagggctcaagtaagctggagagcatgtgtcctatcaaaaggaggaaactactattcagctacagtgctgctgactgaatgggaatgcaagccacttcgtgaattttcctgaaaaanaannn

SEQ ID NO: 55420 - DNA, 2308 bp, Homo sapiens
aagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttattttttatttttttaaaagtttaggtgcctttgcggatgacctcattttgacgttgaaaaaatgattttttaatatgtgaacactgcaaaaatgtgtttaaattatcttttttaaaacctattcaggattattagcctggacttggacacagagtttgtaaataaaggtgtctgtgcagattttcccactgatttatttgtataaaaatactcatcttttcagacttttttgtaaacccccagttgtgaaaactgcagtttagcagtgacctcagcaacccctcctttttattttttcctttaaaaacatttcagttaaattaagctactgatttggatttgttttatcgtatcctaaagtctttgttgttgaaatgaaaggtattttggggttatttattatgaaaacaacatgctcttaatgttgattttacaatatgaagagattatttaaataaattattgttttcattggatgtg

SEQ ID NO: 55421 - DNA, 690 bp, Homo sapiens
cgctgcccaccgctagccagcggtttttctctgccttcttttttctcctcttcgaacccctactgccccaagactaggttcctccactaatgctcaggtctttttcctcaaaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccct

SEQ ID NO: 55422 - DNA, 614 bp, Homo sapiens
gggggcagtttgcaaatattatgatactagacttattattgtacaattaaagggaaaaagaaaactaatgaaaagtgtgaaaagttggcaactttctcacagtctaggcattaaccaaacagttattcaaattgcttaagattcaaacttggtaaactttcttatttttttacaagagtttttttttttttttgagacagagtctcactctgtcaccaggctggagtgccctggcatgatcttgactcactgcaacctccgcctcccaggttcaagcaattctcctgcctcagcctcctgagtagctgggactacaggcgtgcacctacatgcccagctaatttttgtatttttagtagagacaggatttcaccatgttagccaggatagtctcgatctcttgaccttgtgatctgcctgccctggcctcccaaagtgctgggattacaggcgtaagccaccacacacttctatgagcgatatttttaagtaaattatatttttaagaaccaaatttaagaaatataatttttggtattttattactattatatttccaaaggttctaaatcttattaaagtgtgattgtgattttacatattttttatttttt

SEQ ID NO: 55423 - DNA, 205 bp, Homo sapiens
atgcaagaggcttccttctgcctttgtgtgtaatagtggtctggcgtacagccacacacttctatgagcgatatttttaagtaaattatatttttaagaaccaaatttaagaaatataatttttggtattttattactattatatttccaaaggttctaaatcttattaaagtgtgattgtgattttacatattttttatttttt

SEQ ID NO: 55424 - DNA, 1741 bp, Homo sapiens
gaattccggacaggtagtaagataggaagtgaggccaggtaccttgtgggcagtgatgtcattcggtgcgactcctaagatgtctccagagatgggagagctcacccaaaccaggttgcagaagatctggattccacacagcagcggcagcagcaggctgcaacggagaaggggctcatccataccccagtttaccaattcccccacaatggtgatcatggtgggtttaccagctcgaggcaagacctatatctccacaaagctcacacgatatctcaactggataggaacaccaactaaagtgtttaatttaggccagtatcgacgagaggcagtgagctacaagaactatgaattctttcttccagacaacatggaagccctgcaaatcaggaagcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaaggtgtttttcattgagtccatttgtaatgaccctggcataattgcagaaaacatcaggcaagtgaaacttggcagccctgattatatagactgtgaccgggaaaaggttctggaagactttctaaagagaattgagtgctatgaggtcaactaccaacccttggatgaggaactggacagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcagatgagcttccatatctcaagtgccctctgcacacagtgctcaaactcactcctgtggcttatggctgcaaagtggaatccatctacctgaatgtggaggccgtgaacacacaccgggagaagcctgagaatgtggacatcacccgggaacctgaggaagccctggatactgtcccagcccactactgagccctttccaagaagtcaaactgcctgtgtcctcatcgccttccacctttaggaaatgctatctttgctcttctcctactctgccttggcctcactgaggcaccccacttccagtgaagaagtcctccgcaactcccaaacaagcctcgcttgctggccgcaaccaaggagctatctagctctggaggaaactttctttcttaattcctattctctgacgaataaagacttactgcctacaagagg

SEQ ID NO: 55425 - DNA, 1922 bp, Homo sapiens
gaattccggacaggtagtaagataggaagtgaggccaggtaccttgtgggcagtgatgtcattcggtgcgactcctaagatgtctccagagatgggagagctcacccaaaccaggttgcagaagatctggattccacacagcagcggcagcagcaggctgcaacggagaaggggctcatccataccccagtttaccaattcccccacaatggtgatcatggtgggtttaccagctcgaggcaagacctatatctccacaaagctcacacgatatctcaactggataggaacaccaactaaagtgtttaatttaggccagtatcgacgagaggcagtgagctacaagaactatgaattctttcttccagacaacatggaagccctgcaaatcaggaagcagtgcgccctggcagccctgaaggatgttcacaactatctcagccatgaggaaggtcatgttgcggtttttgatgccaccaacactaccagagaacgacggtcactgatcctgcagtttgcaaaagaacatggttacaaggtgtttttcattgagtccatttgtaatgaccctggcataattgcagaaaacatcaggcaagtgaaacttggcagccctgattatatagactgtgaccgggaaaaggttctggaagactttctaaagagaattgagtgctatgaggtcaactaccaacccttggatgaggaactggacagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcgggtgtctgtgaggagatgacctatgaagaaatccaggaacattaccctgaagaatttgcactgcgagaccaagataaatatcgctaccgctatcccaagggagagtcctatgaggatctggttcagcgtctggagccagtgataatggagctagaacgacaggagaatgtactggtgatctgccaccaggctgtcatgcggtgcctcctggcctatttcctggataaaagttcaggtactaccctcatctctgctttgggaatgtttgatggtatttgagacactgacaccaacaattagatatctatatcttagtagttaagagaagagtatctagaacaaggatgcctaggttcagattctttctctttcacatactagctgtactgcctttcacaaatttctttaacttctctggcctcagtgtcctcatctgtaaaatggggagaataatgatgaattttaaataacataagtaaaaagtttagaacagttcatgacacattgtgtgggctatatattaactgctattattagtatagtattattcttagctaacattttcaaagccaacgttaacagtctgcctcaatctggaaaagatgagctagtatttctgtgaagcatgctaccatcaggtgatagtagggcctttcatagcttcatgatcctgattacaagtttctgtccttgctataggggtaatttccccaagatagtgatgttttcattttaaattgtttttcaaatgataatttatttttaaaaaaatatgtaggcattgcatttacagagtatttacacactgactgcataggctgaactgcaaactggggcagctggcctggca

SEQ ID NO: 55426 - DNA, 1912 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55427 - DNA, 140 bp, Homo sapiens
tcaagcttctaacgatgtacggggacatggcaggagaagactttgaattctaacgacgagccgtgttgaaacttcttttgtatgtgtgtgtgtttttttcactattaaagcagtactggggaattttgtacaataaaaaa

SEQ ID NO: 55428 - DNA, 2317 bp, Homo sapiens
  misc_feature (1913)..(1913): n is a, c, g, or t
  misc_feature (1926)..(1926): n is a, c, g, or t
  misc_feature (1932)..(1932): n is a, c, g, or t
  misc_feature (2317)..(2317): n is a, c, g, or t
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaantaaaaaaaaaaanaaaaanaacaaaaaaaaaaaaactctgtttgcggcgcgcgccctcgcggcccctccgaagaaagtctttcttaaaccctttccgttgtggggcgcgcgcgcgggcccacttttgggttagtggtgaaccagtgtgggcccaagaggcgtgtttcccagaggaaatatcgcgggctcccatgaacatcgagcggctcgtggggtttttctccacctaataaaaaaaagcgcccgcggggggcaaaccgcgaaagcgtgtttttgtgaaaaacaatctccccagatagggagagttttccgagagaggtccctagaagcggggactctcttatccagcacgggggagtccccgaaggcgagactccgccaatattccaatattaggcccgcan

SEQ ID NO: 55429 - DNA, 2841 bp, Homo sapiens
  misc_feature (2437)..(2437): n is a, c, g, or t
  misc_feature (2450)..(2450): n is a, c, g, or t
  misc_feature (2456)..(2456): n is a, c, g, or t
  misc_feature (2841)..(2841): n is a, c, g, or t
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcgtgtgcctggggtctcagttcccacctgtggcctatggggggcctgggttttccaggaggcctctgttcagtcccagcattgcccttgtcccgtgtcccctggggtcagcacaggccctccctgtgacagggacccatgatgctgagtcctgtgtcatcagctctccctgccctgaacgttcggatggacagggtgaagtgggggtgctgacagtggcctgggactcggaggcatcaggagggcctgtggagctcagcctgcccacagggagtgggaggtggctgagcgccctgctcggtggacacctaggccacagcaggttgtctttgacacctcgctgatgctccagggtggcggcatgcgtggggtggggttggcctagaggagcaggtcccagctacaccaggcggctctggtgtctctgctgcatggaggacgctcgcccttgccgagcaccctgacctggccttcaaggtgggtgagttgcctgcttgcctgggctgatgctgcctcccgcaggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaantaaaaaaaaaaanaaaaanaacaaaaaaaaaaaaactctgtttgcggcgcgcgccctcgcggcccctccgaagaaagtctttcttaaaccctttccgttgtggggcgcgcgcgcgggcccacttttgggttagtggtgaaccagtgtgggcccaagaggcgtgtttcccagaggaaatatcgcgggctcccatgaacatcgagcggctcgtggggtttttctccacctaataaaaaaaagcgcccgcggggggcaaaccgcgaaagcgtgtttttgtgaaaaacaatctccccagatagggagagttttccgagagaggtccctagaagcggggactctcttatccagcacgggggagtccccgaaggcgagactccgccaatattccaatattaggcccgcan

SEQ ID NO: 55430 - DNA, 2436 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcgtgtgcctggggtctcagttcccacctgtggcctatggggggcctgggttttccaggaggcctctgttcagtcccagcattgcccttgtcccgtgtcccctggggtcagcacaggccctccctgtgacagggacccatgatgctgagtcctgtgtcatcagctctccctgccctgaacgttcggatggacagggtgaagtgggggtgctgacagtggcctgggactcggaggcatcaggagggcctgtggagctcagcctgcccacagggagtgggaggtggctgagcgccctgctcggtggacacctaggccacagcaggttgtctttgacacctcgctgatgctccagggtggcggcatgcgtggggtggggttggcctagaggagcaggtcccagctacaccaggcggctctggtgtctctgctgcatggaggacgctcgcccttgccgagcaccctgacctggccttcaaggtgggtgagttgcctgcttgcctgggctgatgctgcctcccgcaggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55431 - DNA, 2083 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccagaaacagccagaaaggccctttcagaaatgtctgttgcacatgctttcccctctcagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55432 - DNA, 2159 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggagcttgggacccaaagagagccccagatggggcagggtgtcttgggaggagggagttctggcctgcgcttggagctggggctggctgtgggccctgcattgaggcacatctctccgagggtgcacaggcagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55433 - DNA, 2375 bp, Homo sapiens
  misc_feature (1913)..(1913): n is a, c, g, or t
  misc_feature (1926)..(1926): n is a, c, g, or t
  misc_feature (1932)..(1932): n is a, c, g, or t
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaantaaaaaaaaaaanaaaaanaacaaaaaaaaaaaaaaaaaaaaaaaaaaaaaaaaaaaaaaaaaaaaaaaaaagaaggggggcggcgtcgatagataatctacctcctcctggagcgggcccgacgaagcattcgggcgcgcacgccgtgttttagtgaaaacgagagggggccgccacaaatgtaggggcgtggtattatataagaagtagatcaggagacggggcggcggggggtatgaaaaacacggccgctggtgctgggcgagagatcagcagcggtttcgcctgaggtggactcatgtcttggtgagagagcagagctcgccttccttcattgctgtggggggcggcgtcacatcacttgatgtggtgagataagcaactagccctccgacagacgatgttttttcgaggcgtgctgggaggacaacaatattaacaaatcaatgcgagagaacgta

SEQ ID NO: 55434 - DNA, 1951 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaaaatgtgtgcaagtgcttgtacatcactagaaaaagtccc

SEQ ID NO: 55435 - DNA, 1951 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtccagcgcggggcctcgcggcctcctcttctcttgccagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55436 - DNA, 2027 bp, Homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55437 - DNA, 1433 bp, Homo sapiens
agtgaaggcagggagacggatgtaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggtggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaa

SEQ ID NO: 55438 - DNA, 427 bp, Homo sapiens
aatggagtggactgtcaaaaggatgaccacagcgtatggtgggaaagtggacaagacccctccgttttcaggacaggcagctatgtcccagcttgtgcacagcaaatccttgtgcccccaaaatctgcacctagagtagtttaactttttattatttttattattattattattattattattattattattattattattagagatggggggtctcactatactgcccaggcaggtctcgaactcttggcgtaaagcaatcctcccaccttggcctctcaaagtgctaagattacaggtgcaagccaccatgcctggccaggttttggatcctcatgattcaatcttgccaccacagctggaaatgtgctgggtttcactgaagccaacatgtctcagagtctcaaccaaggcctatggtagatac

SEQ ID NO: 55439 - DNA, 466 bp, Homo sapiens
ttctgtcagtttcgtgagcccagggcgttctctacttctcccttgagttctattgaattcagtgtggtattcttattccggaatactttctagctgtatttttatggggggagtgatttcggggggctcttcattccaccaccttgccgactgcaaatggtatttaaaataaaacgataccgaactttattcataagcatcgcataaatcaacctacactgagatacatttcccatgtatcagattggtaaaaattcaaaagatcaacaacacatcctattagcaaggttgtggagaaacagccactctcctacattgctgatgggaaagcacagtggttccaccttgtggagggggatttaccaatatctaataaatatacatattcatttactctttgtcccagcagccccaattttagtaatttaccccaaaaatataccttaacaagtacaaaaaaaaaaaa

SEQ ID NO: 55440 - DNA, 800 bp, Homo sapiens
atcgcaacctggcaggggtgtggggtttgctgggggcctctgtggggccatgatctgaggagggtatgtggggggcgggagctcagcacattccatggcctagaggggccacacagaggccccagtgggacccatggcgtggaggcaggtatggggagttgtggggagatcccagggtggtctggggcctggaaccggccattgggaggccccagcagtttcagtgcccagggcctccctgcagagccatgcatggcagaagaagtgtgtagcatgagctggtacacgcccatgcccatcaagaaaggcagtgtggtcatgcgtgtggacatcagcagcaatggcctggggaccttcattccagataaaaggtaccctttcccaagacgggggctggggtggactccgggggaattcctcaccccagggtccccagaggagccagtgggagatccaagggagagaatggggagaggagaggcagctacgagctgtggaacccctgacactgggacctcacctgcgcctattctgcacctgctgctaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggtgaacggtgtggggcagatggtg

SEQ ID NO: 55441 - DNA, 524 bp, Homo sapiens
cacaaacaccaccaccagctgcctggctctccctcacccccaagggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacagtgtgtgtccagtcccttcccctgcacagttcactgccctcttgcccccactactttgtgctctccctccccattcctctccccgcagactacccaccctttttcctgcggcatctcactttcccccgtctcggtcctcagcttctcgggccaagctaatttcttcttctggtctcaatcccctccaaccccatagttttctaccccttcttcttgattcaagatttggtgacaggagactccggcagtttccagggcaggtaaaggcgtggccagcttgcagctagggcaggtggagggagtggaaggagatgggtgcagga

SEQ ID NO: 55442 - DNA, 4683 bp, Homo sapiens
  misc_feature (72)..(72): n is a, c, g, or t
  misc_feature (363)..(363): n is a, c, g, or t
  misc_feature (1948)..(1948): n is a, c, g, or t
ggaaggggaggggaaggggaaggcgagaaggggagaggcaggggaaagaggggaagagtcgtgggagctggnagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagtnttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggtgggcgtccggcggcgggcgggcaggcctgagacgggactggggcagccgggagctggcttagagggcgaggcctggaggctctcgccccgctgcccaatcccttcacggtgccgggcgatccctgcagccgtacgcggacccggtgcacgaccccacctggcgctggtgggcgaacaacaaacaagaccaggtaggcggagcggattgggagccgggaaaggggcggcgcccggacacccctcaccgtgccccacccccggcgctgactctgccccgcgcatccggtaccccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtgtgtgtccagtcccttcccctgcacagttcactgccctcttgcccccactactttgtgctctccctccccattcctctccccgcagactacccaccctttttcctgcggcatctcactttcccccgtctcggtcctcagcttctcgggccaagctaatttcttcttctggtctcaatcccctccaaccccatagttttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgaaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccatctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcaggaccagcagtgg

SEQ ID NO: 55443 - DNA, 3091 bp, Homo sapiens
  misc_feature (1341)..(1341): n is a, c, g, or t
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtga

SEQ ID NO: 55444 - DNA, 2895 bp, Homo sapiens
  misc_feature (1145)..(1145): n is a, c, g, or t
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtga

SEQ ID NO: 55445 - DNA, 3389 bp, Homo sapiens
  misc_feature (1639)..(1639): n is a, c, g, or t
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagacggagtcttgcgctgttgcccagactggagtgcagtggcgcgatctcggctcactgcaacctccgcctcccgtgttcaagcgatgctcctgcctcggcctcccaagtagctggaactacagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggtaccctttcccaagacgggggctggggtggactccgggggaattcctcaccccagggtccccagaggagccagtgggagatccaagggagagaatggggagaggagaggcagctacgagctgtggaacccctgacactgggacctcacctgcgcctattctgcacctgctgctaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtga

SEQ ID NO: 55446 - DNA, 1457 bp, Homo sapiens
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagacaggtaatgggccgacaccataacaaggcttgagggagacacatctcagatgacggtgaaaacccaatcgccacacgtagaaactacaagaagatcctatgatcctgttttagttctttttcttttttttctttttgtcatggtctcactttcttacccaggctggagttcagtgatgcaatcttggctcactgcagcctccatctcctgggttcaagccatcctcctacctgagcctccctagtagctgggactacaggcgcatatcaccatgcctggctaatttttgtatttttggtaaagatggggttttgccatgttgcccaccttgttcttgttctctaaccaaggagatttctccctgatggcctcatctgtttgtctcctctcttccctgctcctgtctctctccaccactcccttccacactgcccccaggaaacgaatcctcccctggctcatggttggggtccaggtatagatgctgtaacaaagagaccctggaagggaattacttaaacagagactgttgctc

SEQ ID NO: 55447 - DNA, 981 bp, Homo sapiens
ccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacagtttttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgaaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccatctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcaggaccagcagtgg

SEQ ID NO: 55448 - DNA, 690 bp, Homo sapiens
tgttgaagtgaaatccataaatttaaccattttaaagtgaacatcagtggcatctagttcattcacaatattatgcaaccaccaccactatctacttccaaaaaatttccatcactccaaaataaaccctgggtttgtttttatttcatgtcagacaggtaatgggccgacaccataacaaggcttgagggagacacatctcagatgacggtgaaaacccaatcgccacacgtagaaactacaagaagatcctatgatcctgttttagttctttttcttttttttctttttgtcatggtctcactttcttacccaggctggagttcagtgatgcaatcttggctcactgcagcctccatctcctgggttcaagccatcctcctacctgagcctccctagtagctgggactacaggcgcatatcaccatgcctggctaatttttgtatttttggtaaagatggggttttgccatgttgcccaccttgttcttgttctctaaccaaggagatttctccctgatggcctcatctgtttgtctcctctcttccctgctcctgtctctctccaccactcccttccacactgcccccaggaaacgaatcctcccctggctcatggttggggtccaggtatagatgctgtaacaaagagaccctggaagggaattacttaaacagagactgttgctc

SEQ ID NO: 55449 - DNA, 436 bp, Homo sapiens
cggccgccgcgcgtcctggagcgctcgggcttccacaacgagaactcgctcgccatctaccagggcctggtctactacctgctgtggctgcactccgtgtacgacaaggtgggcgtccggcggcgggcgggcaggcctgagacgggactggggcagccgggagctggcttagagggcgaggcctgtggagcggagcgcagcgggattggagaacaggactggtggtgggtgggcgggggacctgggggcggggcctggcttgagcaggacttccaggggaaggcgttgggggtgtggccgggttgaaagcagggtttggggatgggctggggtgtgtatcttctgctctgggttgggggctggctttgaggctaggaggtggtctggggatgccgcttgcctggaggctctcgccccgctgcccaatcccttcacg

SEQ ID NO: 55450 - DNA, 333 bp, Homo sapiens
gaggccttgtggctgggagagagggaccgagggggagaatggtaaggaatgaggtcaaggaagtgagaaggacaaatcgcgtggggccttgtgggtccaggtcaggccttggacctaaatgagatggagtctcaggagagtggggagagtgttggcgtccctcctgtccctccttggcagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtg

SEQ ID NO: 55451 - DNA, 3698 bp, Homo sapiens
  misc_feature (72)..(72): n is a, c, g, or t
  misc_feature (363)..(363): n is a, c, g, or t
  misc_feature (1948)..(1948): n is a, c, g, or t
ggaaggggaggggaaggggaaggcgagaaggggagaggcaggggaaagaggggaagagtcgtgggagctggnagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagtnttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtga

SEQ ID NO: 55452 - DNA, 4450 bp, Homo sapiens
  misc_feature (72)..(72): n is a, c, g, or t
  misc_feature (363)..(363): n is a, c, g, or t
  misc_feature (1948)..(1948): n is a, c, g, or t
ggaaggggaggggaaggggaaggcgagaaggggagaggcaggggaaagaggggaagagtcgtgggagctggnagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagtnttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtgtgtgtccagtcccttcccctgcacagttcactgccctcttgcccccactactttgtgctctccctccccattcctctccccgcagactacccaccctttttcctgcggcatctcactttcccccgtctcggtcctcagcttctcgggccaagctaatttcttcttctggtctcaatcccctccaaccccatagttttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgaaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccatctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcaggaccagcagtgg

SEQ ID NO: 55453 - DNA, 1545 bp, Homo sapiens
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagacaggtaatgggccgacaccataacaaggcttgagggagacacatctcagatgacggtgaaaacccaatcgccacacgtagaaactacaagaagatcctatgatcctgttttagttctttttcttttttttctttttgtcatggtctcactttcttacccaggctggagttcagtgatgcaatcttggctcactgcagcctccatctcctgggttcaagccatcctcctacctgagcctccctagtagctgggactacaggcgcatatcaccatgcctggctaatttttgtatttttggtaaagatggggttttgccatgttgcccagcttggtcttgaactcctgacctcaagccatcctcctgcgttggcctcccaaagtgctgtgattacaggcatgagccaccgtgcccagccttgttcttgttctctaaccaaggagatttctccctgatggcctcatctgtttgtctcctctcttccctgctcctgtctctctccaccactcccttccacactgcccccaggaaacgaatcctcccctggctcatggttggggtccaggtatagatgctgtaacaaagagaccctggaagggaattacttaaacagagactgttgctc

SEQ ID NO: 55454 - DNA, 2770 bp, Homo sapiens
  misc_feature (1020)..(1020): n is a, c, g, or t
atcgcaacctggcaggggtgtggggtttgctgggggcctctgtggggccatgatctgaggagggtatgtggggggcgggagctcagcacattccatggcctagaggggccacacagaggccccagtgggacccatggcgtggaggcaggtatggggagttgtggggagatcccagggtggtctggggcctggaaccggccattgggaggccccagcagtttcagtgcccagggcctccctgcagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtgaggtccaagcctggaggggagggcaagcgcctggccttcgacatcacctacacgctggaatacagccgcctgaagaacaaacactactttgactgcgttaacgtgaacccggagatgccctgctttctcttccgggacagtctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtga

SEQ ID NO: 55455 - DNA, 1982 bp, Homo sapiens
  misc_feature (1341)..(1341): n is a, c, g, or t
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatacnctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggaggtgggctgccccgcccctctccccgttccctctctgcccacccccaaaccccaggggcccctctttcccccgtcacagtaaaggagccaagggaagggggcaccctcggggaccctgagaaagggcagtgaagctccatttataactgaaactcctggaactcagggtaagtgtcagctccaaagtcacgcagaccggagctatgatccgatgttcagaggcggccctctttcatcccacagtgtggtcgttcacttcataaatattgagcatttaaa

SEQ ID NO: 55456 - DNA, 618 bp, Homo sapiens
tgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtataaagcgttgagagtacaacctgccggtgg

SEQ ID NO: 55457 - DNA, 327 bp, Homo sapiens
gtccctttaaaaaagtaaaaataaaataacattcagtaaaacttctaatattccatttatgttggatgagaaaaattaactttagaaatttcttgctatagttttcacttcaacagagctactgcatctttaatacattactaatatggaaaatttttaaatcaattattaattgcaattagagaaacagcttaactgatttatgtattaaaatacaaaaggcaaatacaaagctatcttctcatacataaaaggccagggttttgaaaggcagtgtcaacttgtaaattatcttaaagtactgctacagtagtctattttttaaaa

SEQ ID NO: 55458 - DNA, 346 bp, Homo sapiens
gcataggcagcccctgctcttgcatttacctcccacgtgaactagctgctcagtcattgctctggaatatggagttgtgatctagaaattaaagatgggattaggtaaccagtgaggtcccttctactgccagtgtatgactctcttctttgtaaatgtcatatgtagggttctgtacacaggacattttcttcattgtagttcctcagatgcattgagctctcctgaatgacttagcggggaagctcagttgcagctgaccgtattaagggtcctctcccattgtgctgtgccgctcgttagcgtagcatctgccccacgccctcctgtttctgaggctggcttt

SEQ ID NO: 55459 - DNA, 428 bp, Homo sapiens
acacataggcaacaaatgtcagtctcagaaaacttttctggtaagttttccagacattcaaaatttaaaactgaaaagcataatgttgatattatttagcctcttccaaaaaatagagtaagtaaaaaaccctgcataacttaattcctgagttaataccaaagcttgacagaaacaaaatgagagcaactatagacaatctcattaagacaaatagaaaaaaatgttaaagcaattgctaacaaactaaattttgctctgtaaaaaataaataaaaccataagtaagtttggtacagtataagttgaaattgtaaaatctacatgtctatatataataggcacagaaaaagagtttggtaaaaactttttagcaaactagaaataaaagaaaatttcattttattttctaaatatacaaggtatcta

SEQ ID NO: 55460 - DNA, 307 bp, Homo sapiens
atctttaacatattaaaatagacatgagaaaaatgtgtcatttgataaaatgggggaaatgtaataaatgattaccagaaatataaaattaagccgtatatgctcttaagtaaatcgaatctaggcatccttaaaatgtaaaaaaggatgcaacaagagtaaggagcccagaatgatgtaaattacaggaatggggtgtaatgtaacctctagaggaggtgatgtttagaagaagcaaagagaatgcaatgagaagcaaacttgttttaggcaaattctcctggagtggaccaggcagccccctctt

SEQ ID NO: 55461 - DNA, 795 bp, Homo sapiens
caagttgcccagtgatttagtatgagaatctttattgtcgtaaaagtgcctaacaatgctaggcaggaaggcaggaagcaggaactgagggcaatgtgtccttggaatggcccagagaagaggctgagactcttaccttgactctgagctgacttaaagggtctggtataatggcagttcttttactgaactgcactctcttctagtaagtataaaaaagttctactggcaataataatagcaaacatgtatcaggttcttactgtgctaagcactttaattctgttattggactttcaaaacaacttactgaggatgataccattacttttcctgtattacagcagagggaactgaggtttagagagagaaaataatttgccaaagtcatataattgttgtcttatataattgttcatcccatagagaatggcattttcatttctacagagatcagagtgtgttgttttctatttcctgtctcaaatgtgttactcctcatctctgccaaagcaggctctatttatcctgcaagaactgtggaacctcctcgacttccatcgtaaactcttcctgggacccagtgacttctcttcccacagcatacttggagaatttatgcctgcctcatgtatttggcaattgatcataaatggtcctacgctaattctcatttgtcatatgatattgtttaattttgtttaatctttccatccagattgtaaactccttcttgtttctggctgtgtctaaaggattaaaagtgagtcttttatactattcaccacaatgcac

SEQ ID NO: 55462 - DNA, 359 bp, Homo sapiens
gacaaagctttctccttataatcaagaacaagacaaatctgttcactctcttgccatttctatctaacattatactgtaagtcatactcagggaaattgggtcagaataatacataaaattggaaaggaagaagtgaaattatcttttttgtagatgacatgatcttctacatagaaaattaaaagaagtccacaaaacattacgttagctgtttaaaaatctatccaggcctgcagcaactcgattcttgcctcctcagaagaaagaattatgctgaggggcataaggcagggtgagagaccaaggtgagttttagagcaggagtgaaagtctattaaaaagttttagaacaggaacg

SEQ ID NO: 55463 - DNA, 522 bp, Homo sapiens
ccagaatgcactgaacttgatcctggcaaataaattggaagctgtttccaaaaaagtgatatgttcttgctacattgtctccagagtttactcctgagttggggagcagcatctcattttgcaaggggctgttggattctccatagaaacgctgggttgggggagtgtcttctgagtactggggctctacctaatgtctgattccatctgtggtaccaaaaagcccctctgaatggcagcctgtctgtgcacaatgatgccgaagactttcttttccagcatctaatgaggcatggccccaggaaagcagagaaggcggatgcttgagtctctgagggtcagaatacgcttatggtgaaatcagaactggggacaaggcaaagtactgccattgggaatccggggtggatggtcatgttagaccaggggtgtccaatcttttggcttccctgggccacttggaagaagaattgtcgtgggtcacacataaaatacactaacactaaccatagctgatgagct

SEQ ID NO: 55464 - DNA, 291 bp, Homo sapiens
tgaaaatggactaatgcacctgtactatccttttggggtttatttctccttctttcctcatttccattggatgactaaagtttcttctgctggcttaaaaattacttcttttgttgttcctcttgtgcagttctgctgaacataataaccaagtgtgtatttatttaaatctattgatttgttgaacgtatcactacctgtatcttccctctaacaaaacactttcacatattctcatatccctttgtttttatagaccactcctctccttcatcatttttgtattttgcc

SEQ ID NO: 55465 - DNA, 1250 bp, Homo sapiens
gcctggtggcgaattcggcacgaggggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55466 - DNA, 969 bp, Homo sapiens
gtctaggtttgtggtggtgtatccggattgcggttggggagagacgtcgttgactgtgtggctgtgctaatgtgcgatcgtatcggcgtctcgatcggtattctgtcgtagtgcacgggggtgatgcggcgtgggtggctgtggtgagtcttggcctgtgtgatgttgctgtatacttttttttagttttgtggtatggtgccccggcgttattatttttctattaacatatctgctctgtttacccaacttcttataacgccgtacacaatatagttccttttgtgtcaaacaacctctaaactacctctataaacgttttaaattttcccctatacacgtttattattcctgctgggggtgtgtttgtccacatttgtgtgtccccccctccggtttgggtgttcctctttcagaggtgtccctcgtgttcgccgttgtttgcgcgcgtactcggcgtggtgtgatacgcgggccctggtttagttttttttcgtctctctttatggggccccctttgttccctatttcggtgttacgttttctgggcccccctcgggtgtttttgttcctcccccccgtgtttttttttttttttttttttttttttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55467 - DNA, 403 bp, Homo sapiens
taaatcgagctcgtaccgctccacccgacggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccgtatgccccgccgtatgtagttacgcgaccccccgcagcatgcatcccacgcggaatggggacctctagagcgacccc

SEQ ID NO: 55468 - DNA, 140 bp, Homo sapiens
gcggccgcctactactactactactgctcgattcaagcttctaacgatgtacggggatgggctttacccttccctgcgggctctctccccgacacatttgttaaaatcaaacctgaataaaactacaagtttaatatgaa

SEQ ID NO: 55469 - DNA, 463 bp, Homo sapiens
gcggccgcggcaccggaagtgccccccacgggaggctgccctcggggtcgcaggccgcatggccaagcgtggaccggggccgcatggcagcgcggggacccctccccccaggtcccggccaccggaagcccggaacggccacatggtcggcaggagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtgtaagtggcaccccttcgagctgggaggccggagaaatggggaaacagggcgtttggacaggagcccaacttttctgtcggcctgggtggacagcgcctaaaagcctca

SEQ ID NO: 55470 - DNA, 559 bp, Homo sapiens
taccatctaagtttctttactgaggacctcagagccgaatggcctctatggatgccatagagaccaatacggactgagggtttaaagaagatggtgtccgccgcaggaccgctctatcttctcgggtgaactctatggcagagcataggcattcgatttagagaagtgaagccgagatgggtgggaacccgaccacactagcgcgctagaagagtggggcggaaagacatctcccgcgcatgtgtggaactggggggactgattccaagacaaggcgcccaccccacagagcaagttttctgaaacgtgtgagtcgtttaagtccagttaaagccgaggtggggcgtatcctgagacgcatgcgttctagacgagacaagtgatctagcggcgtggtcttttcaacgcctggcgtactgacggcgtctgaggtggaaggggttgtttaggattccgaacacgcatgcgttctgagacccaggcgtttcctttagagggtgtggagtgcagggctccttattgcgcaggcgcaaggactgcccggtaggacgagcggtct

SEQ ID NO: 55471 - DNA, 977 bp, Homo sapiens
  misc_feature (801)..(801): n is a, c, g, or t
  misc_feature (804)..(804): n is a, c, g, or t
  misc_feature (807)..(807): n is a, c, g, or t
  misc_feature (810)..(810): n is a, c, g, or t
  misc_feature (813)..(813): n is a, c, g, or t
  misc_feature (821)..(821): n is a, c, g, or t
  misc_feature (827)..(827): n is a, c, g, or t
  misc_feature (843)..(843): n is a, c, g, or t
  misc_feature (847)..(847): n is a, c, g, or t
  misc_feature (852)..(853): n is a, c, g, or t
  misc_feature (856)..(856): n is a, c, g, or t
  misc_feature (858)..(858): n is a, c, g, or t
  misc_feature (861)..(861): n is a, c, g, or t
  misc_feature (977)..(977): n is a, c, g, or t
gagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccagcggnggngcngcngtntcttgacnggaggncctccgagctggtgtnggcngctannggncnctncattttggtttttggttcccccttgtgggcggctcacccgtcggggagggggggccttcccaggggggggggggcgcatagacgggggccccgtcatcctgctctttggctgcggn

SEQ ID NO: 55472 - DNA, 579 bp, Homo sapiens
gagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactggaaagctaaacagtctaaattaacatgaaatacttcattttgattgaggaaaaaaataaacattcagaatttttttcaaaggtcaaaaaagaccaactaaacaaacaaaaacaaaaacccacaacacaataactaacacaaaaaacacagacgggggg

SEQ ID NO: 55473 - DNA, 1012 bp, Homo sapiens
gagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttggggcaaactggaggagagaaagcacatggaaag

SEQ ID NO: 55474 - DNA, 1101 bp, Homo sapiens
gagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactccttctaagaattattgacgttatttgggttcccacccttatttggggaagccctggcccttactatgatccttggacaagagcaaacgaaattgtgcgctgtgtacaacgacctcctattgtcccgcttgattagccccgtgtggggacaaagggcgggcgtccgcgcgtgatgagtactagtactagagtaggaacacgtgctaataaaccgggcagtcgaggaagtgtagcgcacatacaggtcgaccacgctgatcgaccagacttgagccacgtagggagctcagctagtgcttcccacactagg

SEQ ID NO: 55475 - DNA, 1301 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55476 - DNA, 1856 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaaaaaaacaaaaaaaaaaaaaaagaaaaaaaaaaaaaaaaaaaaaaaaaaaaaaaaaaaaaaaaagaaaaaaaaaaaaaaaaaaaagagggggggggcgcgcgtcaagaaataacccctccgcggggggcgggcccctaagttaggtgcgcagcaccaccgcataattgtgtttggagacaagagaggggcgtccaccacaataggggaggctgctattatatattaagagcacagcgagcgagagagcgagcgacagcgatttaaacaaaacaggagggaagagcggcggcgaaacaaaaatgaagtgagtctaactaaggggagagaactatctttgtgggagagaacgagaggagacccctcttactatcggtgggggggggagagggaaagaacacaacaatagtgtggtgaggggcgaaccaaaaaacttctctcactcattgcaaaggatagattatatattatagcaacgcactccttgagaggaggggaagaacaatatatctaataaaacatgtattatagaaaagatggaatatcataataaggc

SEQ ID NO: 55477 - DNA, 1260 bp, Homo sapiens
tcccattttggcttttaggggtagttttcacgacacgtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55478 - DNA, 1248 bp, Homo sapiens
tactctataggatcccgaatgagggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55479 - DNA, 1835 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaagaaaaaaaaaaaaaaaaaaaaaaaaaaaaaaaaaaaaaaaaagaaaaaaaaaaaaaaaaaaaagagggggggggcgcgcgtcaagaaataacccctccgcggggggcgggcccctaagttaggtgcgcagcaccaccgcataattgtgtttggagacaagagaggggcgtccaccacaataggggaggctgctattatatattaagagcacagcgagcgagagagcgagcgacagcgatttaaacaaaacaggagggaagagcggcggcgaaacaaaaatgaagtgagtctaactaaggggagagaactatctttgtgggagagaacgagaggagacccctcttactatcggtgggggggggagagggaaagaacacaacaatagtgtggtgaggggcgaaccaaaaaacttctctcactcattgcaaaggatagattatatattatagcaacgcactccttgagaggaggggaagaacaatatatctaataaaacatgtattatagaaaagatggaatatcataataaggc

SEQ ID NO: 55480 - DNA, 1273 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatccccgtacatcgttagaagattgaattcgagcagtagtagtagtaggcggccgc

SEQ ID NO: 55481 - DNA, 1287 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggtgttcctttccacagtctcattcctctcgttctataattaattccccttaaagtttttcaatctagggctccagtatatccccttgagccaccttgtttagctctttttatagcg

SEQ ID NO: 55482 - DNA, 1262 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggcaccggaggaggtgccggtggggagcccgcatacggtgtcctcgcactggcagctctcgatgtgggtgtaggtgtgtgtcagcgagccgc

SEQ ID NO: 55483 - DNA, 1379 bp, Homo sapiens
  misc_feature (1248)..(1249): n is a, c, g, or t
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagcccgccgccaccatgcccaagagaaaggctgaaggggatgctaagggagataaagcaaaggtgaaggacgaaccacagagaagatccgcgaagttgtctgctaaacctgctcctccaaagccagagcccaagcctaaaaaggccctgcaaagaagggagagaaggtacccaaagggaaaanngggaaaaagctgatgctggcaaggaggggaataacccttgcagaaaaatggagatgccaaaacagaccaggcacagaaagctgaaggtgcttgagatgccaagtgaaagtgtgtgcatttttgataactg

SEQ ID NO: 55484 - DNA, 976 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttggggcaaactggaggagagaaagcacatggaaag

SEQ ID NO: 55485 - DNA, 1445 bp, Homo sapiens
ggtaacatatctcttatatattacagtttctttaactttaataaagctgcagtatcctggtttcacaggaactcctggcccttccacgaacattcaaaaaggatccactgtgttctataataagtatcataggaacccacccacaaaggggaacacactggatcctttttaaacgtttttaatatataagagatatgttacagtttctttaactttaataaagctgcagtatcctggtttcacagagagagagagaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55486 - DNA, 1268 bp, Homo sapiens
gcctggtggcgaattcggcacgaggggtagaggcggcggcggcggcggcagcgggctcggaggcagcggttgggctcgcggcgagcggacggggtcgagtcagtgcgttcgcgcgagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55487 - DNA, 1135 bp, Homo sapiens
ttcattcataggtctgcgctggggccgggacgaagcacgacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55488 - DNA, 1163 bp, Homo sapiens
tttatttcaagttacggggctggggtttagattgtatacttcattggccgtggcagcacatttacagacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55489 - DNA, 983 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccagaggaagaagtgggctggtgaagtgcctcttttcctaataagctgggggaaagggggggggggcgcggactttttgacaacggacaacagggtctcaagggtgggccccaactggggggggggttttcgcccag

SEQ ID NO: 55490 - DNA, 1062 bp, Homo sapiens
aggagtacgactgtggagaagagatcctgatcacggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55491 - DNA, 1082 bp, Homo sapiens
agaggatcgagcgaggagagccaaagctaagacccctgcagccagacgagctacggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55492 - DNA, 2518 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgctagcacttccctcatcacctcagacttttcctgtctctttagaatttcaacctgattcgttcttgttgaatttcttgtggtgtttttccttaatcagtttttccatcttttgacttgacattgatcttggattattctctagtgtctggatccctctctgtgctcttctggcttccttattttctagctacatagttatttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaatctcaacggtggttttttagcctctgttttttttctttaagaggctttactgtttcttgagttgactggttcaattccaacactccagtctttgccccaacaatgtaattctgacttccctcatcaggcaaggtcaatttgagcctttatttcctccgttttagagtttggttgggtttctctttgtgatgcatacatacaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55493 - DNA, 1007 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55494 - DNA, 827 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccacccaagaacagggtttaaaaaaaaaa

SEQ ID NO: 55495 - DNA, 826 bp, Homo sapiens
taaatcgagctcgtaccgctccacccgacggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55496 - DNA, 878 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccgtatgccccgccgtatgtagttacgcgaccccccgcagcatgcatcccacgcggaatggggacctctagagcgacccc

SEQ ID NO: 55497 - DNA, 1472 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55498 - DNA, 863 bp, Homo sapiens
gttgtgggggacggggagaaggggacagcttggcaccggtcccgtgggcgttgcagtgtgggggatgggagtatgcagcttggcactggtactgggagggatgaggatgacggtaaggttgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55499 - DNA, 1065 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactccttctaagaattattgacgttatttgggttcccacccttatttggggaagccctggcccttactatgatccttggacaagagcaaacgaaattgtgcgctgtgtacaacgacctcctattgtcccgcttgattagccccgtgtggggacaaagggcgggcgtccgcgcgtgatgagtactagtactagagtaggaacacgtgctaataaaccgggcagtcgaggaagtgtagcgcacatacaggtcgaccacgctgatcgaccagacttgagccacgtagggagctcagctagtgcttcccacactagg

SEQ ID NO: 55500 - DNA, 788 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctctcctcgctcgatctaacggggatcctctg

SEQ ID NO: 55501 - DNA, 1115 bp, Homo sapiens
aaggtgctgtttatacaccttccaaaaaatcaagacagttatgaggaaggggacctcaaatggtggtatagctcacccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55502 - DNA, 757 bp, Homo sapiens
catatacgacttgagctcagtaccctcgatagggctattcgtgcctagtcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55503 - DNA, 910 bp, Homo sapiens
gcctggtggcgaattcggcacgaggggtagaggcggcggcggcggcggcagcgggctcggaggcagcggttgggctcgcggcgagcggacggggtcgagtcagtgcgttcgcgcgagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggctgggagttgcctctcttttccttaataagctgggggggacagggggggccggagggcacactattcagggcggg

SEQ ID NO: 55504 - DNA, 936 bp, Homo sapiens
gcctggtggcgaattcggcacgaggggtagaggcggcggcggcggcggcagcgggctcggaggcagcggttgggctcgcggcgagcggacggggtcgagtcagtgcgttcgcgcgagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaggatggcggtggtggcagcagtgatcggctctggcccggtcctaagctggactcctcctacacaatttatttgacgttttattttggttttccccaccccctcaatctgtcggggagcccctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55505 - DNA, 614 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccatgcctcccagtatctttggcgctccccaccagcaagctgcccaccagtgctgactttccctttaactctgcttttacagtctgattgtttttgtttagcgctcacataagacc

SEQ ID NO: 55506 - DNA, 2464 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgctagcacttccctcatcacctcagacttttcctgtctctttagaatttcaacctgattcgttcttgttgaatttcttgtggtgtttttccttaatcagtttttccatcttttgacttgacattgatcttggattattctctagtgtctggatccctctctgtgctcttctggcttccttattttctagctacatagttatttctgatctccctgcaagtccttttcttcagctctttcacatttcttagtttcttatcctttcccttctaccttccttattccccagtttctcagctccttctcctggtgtccggtcttatcttttatcaaggtaactgtcttctccaagcctgccatgcagttttctattgtgctgtcaaccccaatctcaacggtggttttttagcctctgttttttttctttaagaggctttactgtttcttgagttgactggttcaattccaacactccagtctttgccccaacaatgtaattctgacttccctcatcaggcaaggtcaatttgagcctttatttcctccgttttagagtttggttgggtttctctttgtgatgcatacatacaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55507 - DNA, 1011 bp, Homo sapiens
  misc_feature (35)..(35): n is a, c, g, or t
ctagaggctccccgatattctgatccagtctactncgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55508 - DNA, 1006 bp, Homo sapiens
ctctcttcaccctgccgtcatgtctaagtcagagtctcctaaagagcccgaacagctgaggaagctcttcattggagggttgagctttgaaacaactgatggctcctcaggctccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55509 - DNA, 929 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55510 - DNA, 845 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccatttgttaaaatcaaacctgaataaaactacaagtttaatatgaa

SEQ ID NO: 55511 - DNA, 1568 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccagggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55512 - DNA, 1263 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaggatggcggtggtggcagcagtgatcggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55513 - DNA, 806 bp, Homo sapiens
  misc_feature (761)..(761): n is a, c, g, or t
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactccttgntgcctctggcctccttggtgcctctggcctccttggtgcctctgg

SEQ ID NO: 55514 - DNA, 1230 bp, Homo sapiens
gcctggtggcgaattcggcacgaggggtagaggcggcggcggcggcggcagcgggctcggaggcagcggttgggctcgcggcgagcggacggggtcgagtcagtgcgttcgcgcgagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaggatggcggtggtggcagcagtgatcggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55515 - DNA, 800 bp, Homo sapiens
gttgtgggggacggggagaaggggacagcttggcaccggtcccgtgggcgttgcagtgtgggggatgggagtatgcagcttggcactggtactgggagggatgaggatgacggtaaggttgagcagaagtacgactgtggagaagagatcctgatcacggtgctgtctgccatgacagaggaggcagctgttgcaatcaaggccatggcaaaataactggctcccagggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 55516 - DNA, 586 bp, Homo sapiens
ttgttattgtgtgttgtcaattgggaatcaaaaagggggggagggtgtaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagatgatgactccgcctacacatttttttctta

SEQ ID NO: 55517 - DNA, 1391 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55518 - DNA, 769 bp, Homo sapiens
ggacgcgtgggtcgacccacgcatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55519 - DNA, 519 bp, Homo sapiens
tttgtttatggtattttttcttcttttcagtgaaaagacattaaaatggagccacaccataattactattttatagccgccttctttccacttaatctatcataaacattttttcatatccgtagctatgggccatgatcttcattttcaatgcagacacttgcatcgttctattttaattctttccacagatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55520 - DNA, 1635 bp, Homo sapiens
acctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaacaaggcatttatctacagagctcaactagaaccccttttcattaggctactccacttccttcccctcatagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55521 - DNA, 1798 bp, Homo sapiens
acctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaacaaggcatttatctacagagctcaactagaaccccttttcattaggctactccacttccttcccctcatagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagagaactcccatcagcagcgcccgacagcactctcctcctcactgcccaacactgggtggcaaatcttttcatcttggccactctgataggctggacagtgaggtccttcttcctagggcgcatggaaacctgttgcagtcacctgggtttgcggagtgggaggaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55522 - DNA, 1494 bp, Homo sapiens
cgctaggtacgaggctgggtttaaatcggccgaggctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagagaactcccatcagcagcgcccgacagcactctcctcctcactgcccaacactgggtggcaaatcttttcatcttggccactctgataggctggacagtgaggtccttcttcctagggcgcatggaaacctgttgcagtcacctgggtttgcggagtgggaggaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55523 - DNA, 1166 bp, Homo sapiens
agcggagaggttgctggggtagccggcgtgggcggcgtcactgagccgcgccagctgagccaggtagtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55524 - DNA, 1226 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55525 - DNA, 832 bp, Homo sapiens
tcctctttcccatcttcccatagatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55526 - DNA, 2001 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtcaaaaaaaaaaaaaaaaaaaaaaaaaaaaaaaaaaaaaacaaaaaaaaaaaaaaaaaaaaaaaaaagaaaagagaggcgggggcggccgagcgcgcgaacaagaaggactcctcccgacgagggagcgggcagcaagactagcgagcgcgacgccacgccgagttgtttatgaagataaaagagggcgccgccccaatatagaggaggaggcgtgataattataacaagggagcggacggcgggccgccagtttatataacaacgagcaggagagagaggcgggaaaaaaaacgcggctgcgacgtggcggagaactgctcgtgaggaagaagaagaccacccacaccgacggggaggggggaggaacacaacaacgggggggacaacaaaatccacccctcaaggaagagaatattttacaacacccgacggcgagggagaagaatataaaaaaatttgatcgaagagcggacgtaatcaggtgtggagcgaaaccacacacagccgcaaccctattttgtcgccccgtggtatgaagaagaattggagtggccagagagtgagttgatacgtatggaaaacaaattgtttttctcaacgggggggagaa

SEQ ID NO: 55527 - DNA, 1540 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtcaattaattcctgccccaaaaaaaagggcgggtaaaattcccagggccattacgtccacttttgtaggcctagggggaaaaagagggggaaagtggacagccggtctgggccctggggaggacccaaacggaatgtacgcggtggagaag

SEQ ID NO: 55528 - DNA, 1445 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtccccccaaagaaaagtaaatgcgtccgaatttaatttttcctcttttctggggga

SEQ ID NO: 55529 - DNA, 940 bp, Homo sapiens
cctgatttaaaaatccttaaacactattgctcttaggtgcctagtgcttgatatgtggaagatgatcagcacatgtaagagtaaagaaataaaaagtattgtgtgtttttccccaggatgaagatcttctcccaagtaaatattttgaggttgactttccaatgattgtcacgagaaagctgcacagtatcaaatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55530 - DNA, 1070 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55531 - DNA, 1299 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55532 - DNA, 1293 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcagggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55533 - DNA, 381 bp, Homo sapiens
gtgctccggtggtttacctcctacaacaggttacctcgagctgaatatgagcgatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55534 - DNA, 331 bp, Homo sapiens
cagtgtgacctggcgggagtggagacctgcaagtcattagagtcacaggtcagagagcagggactgggatatccatttggacccttagtcaaccaagatatataaaggtctttctttgcagatatgatcatggagaagccctgttcagtgcctgtcagcagcacaggctgctgagcctccatgtgggccgctagttcatgatgctgggaagaccaagtcctgcttcaccatcacatttcctacaccctattattttgactttgtattacgcaaattttcaaacaaacataaaggtagagggaatggtgaaataaacacacacgtctcatca

SEQ ID NO: 55535 - DNA, 1482 bp, Homo sapiens
  misc_feature (1456)..(1456): n is a, c, g, or t
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtcatttcacttcatttctttgaaacaccactctgctgggccagccaagtcctgcaattcacattaantctcgcagctagctgcgttcttcatc

SEQ ID NO: 55536 - DNA, 1331 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 55537 - DNA, 845 bp, Homo sapiens
agcggagaggttgctggggtagccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaagtaagtgtggcatggccagaagaacaaaagccagcgagaattcagatccagctctcaagagatggcagatctgaatgccagagacttcactttagggtgttgccttccgttcactgccccccaccaactttttttttgccctggcactcattccagcatgttctacagtctgcaaaatgcaatatacatttccttattacagatcacaggctctatggctccccatgtaattacaattaacacgaggccaaccaaatctccca

SEQ ID NO: 55538 - DNA, 298 bp, Homo sapiens
caagtcactgatgtttgtgtatgtctacgtgtatgtgtgcttgtgtgtgtgtttctgtatgtatgcatatttgtgtctgtgattgtgtgtgtttgtatgtgtgtgtgcgtgcgcatatatttagcttttcctcataaatctttattattaaaatgagctcacaacagaagaggatgagaactcttgggctatgtaggaaatgcagggccagagggtgtattaggatcaagaagaggccagacccccaggtcgtggacctcctcctgccatgggcccacagcccatgtggttttgtgag

SEQ ID NO: 55539 - DNA, 472 bp, Homo sapiens
aagaaaggggtggcagtggcaactgtcaagacattttataacttttactttcaagatagtgtctagacttcttttggaaattttcttataatctcttagttttttatgtcaagaaaaggactggtgtagcattaagacctattctggcatcaatgatattagggaaagcttttaaccatattggcagagccagactttaagggctaagtcatatgacttgggcagggaacagccttttttaaagatcatgaaattatttcacatagtgcgattttttgagtttggcttgatggatgtttgctgatccagacgttatcattggtgacattatttttagtgaaatgaaccaggagtgagtttgttcactgttggctgtatttttacaaaatgagctttacaatattttttctgacttaaaaaagtcatacatatcactttagaacacctcgtacaaagtagggagttatttaaa

SEQ ID NO: 55540 - DNA, 183 bp, Homo sapiens
ctaaaacatgacattatcaggcttactgattttcaaattagggctttccttaatttttaaatgcttggaatgcttattcttctacataaggcaacatgatgctgagacagttacactccctcttcttttttaaatatgaaggagattttcaaccatcttttataagtaagaaaatagaagctg

SEQ ID NO: 55541 - DNA, 2477 bp, Homo sapiens
  misc_feature (1555)..(1555): n is a, c, g, or t
  misc_feature (1702)..(1702): n is a, c, g, or t
tgaattattaatttttgcggctggacgcggtgactcatacctgtaatctcaacactttgggaggccgaggtgggcagatcacctgaggtcaggagtttgagaccagcctggccagcatggtgaaactctgtctctactaaaaatacaataattagctgggtgtggtggcacgcacctgtaatcccagctactggggaggctgaggcaggagaatctcatgaacccaggaggcagaggtggcggtgagctgagattgcaccactacactccagactgggatttaagaaaatgtgtagttaaatattgcctaaaatgctcgaatgtaggttataaacaatgagaatagggcccatgaagagattttcgtttttcacagaggtgagacttaaaaaggccttgaaggataaatagaaatagaagcagagtagaagggttattccaggagaatattagtttggatgagggcacagaggcaggaagatggagcttagcttgagggaatggaggtcactggtgctgtgaatatttgcagacagccatatccagagctgagaggtgaaagaacagactggaatagttcttttctttttcactctcctaccttatttgcttttggtttagcaaggaggatcgaaagtaaaccaagagaaatggtggggggcagcagagggaggtgggagggaaactccaggatgagttatggtcagccaaaagaagctgttgaaataaaatgaccaagagttaatgcctttatagacgcagggatgcacagcctagatccccttcctctaaaggacttgctgcccatccactgaaagcttggtcagcagccagcccccagctatcggctctttcagggcctgccttgttgcaaagggccgcctccctgcaaagagctgccttgctcaaagagctgccttgcactaggtcatgctcttctggtggcagcttgcatcctgtcacagagaggcaggggtgtgaaagcacagccatctcatttgctctgcaggacaatatccactccagagttcctgctagactggccaagaccttgttgccattcaacttctttcccattctactcgctccctccttccttcacaggtgttgagccctaataaaattttgcacccgaaattctgcttcattatctgtttctggagaacccaacctgtaacattttcccagccagggctgaatacacacacacacacacacacacacacacacacacacgtgctctctctgtatatatgtttctgtgtatgtatatatgtatgtatatttttaattacttttctccattcaatagtatactgcctatcaattattagcaaattgtattttcaacctgttggcttatttattctaaatatagccattttcctctaaagagaaatctttgttgccaaaagaattttataatggcaaaatcagtcattttccccactaatcgcaatgtaattttgcccattttgagatgggcaaaaatcatatgttcagaacagtaaggtgagacagaatcagctaatttactgataactgtgggcactanctgaactgacgtatcatgctgctacgcactttagtaccaggctctctggtggccagttctttgcaggataacgtggaataatgcttatgtaaaatatgacttccaagactaattctcaacttcagactccccactcccagcattatngctttggcattagtaatgttagtcagaaatatgagtaattcttggcaagaatgggaagcattcaacttgtaacttcaaaaagacattatctgaaaggttgaaagccagtttctaatagtacctggtgtcttggcttcagggctcacagcaatcctgtggagaaagtatgagtttcccatttcaacaaagaaggtgaggcttagagggaaaggaagttgctcaagatttgctctggaacagagccaggattcccactcagatcttcgactctgaatcctgcaggccttcacctgtgcgagcactgagcgcctggctgccagctccagagctcctctggggccttggtcagtgtggtgttgtttatgtccagcacactttccgttggtctactggaggacagttcctgtacaggcagatgacttccttcaccaaggacctgtgactctctccctgagggctttctctgacatcatctgcacatggacagcttagactgaaagtttcaggggttcgatgccttccagaggcacctctctaacaataagagcccagattgagtggaaataccccagcttccttaccactccagcctccatgcccttagtggcatgattccgaggtgcatcctacactgactcttggtggctccctggccagagctcattcgcgtggccctcagcagctctcctccttccctggctgtcttcctcaccacctctccgtgattccaggaatcagctcccgaataaacgacttgcacccgaaaattgtctca

SEQ ID NO: 55542 - DNA, 376 bp, Homo sapiens
tcttttgccctaaatagacatcattggcatcttctatcatccccatcaccagtgaaagaaaagtagaacatccttcccctctactcttcagctctaagtcagagagactgggaattgaggaaaatttgaagtaggagtatcctgaatttgacaagatccgtcttgtagtctaaaggaccttgctatcagggtcatatcacttccctgaagtgggttagacctcatttcatacctgtgagcaaaagccatagtttctctcttgtggcagttgagccagtgcaaaaactgcaggctgcctttcagaccaaggagattcccaatggccttctgctattaaaggaacaaaaagtacacaattcctttgctgcaaaaacaa

SEQ ID NO: 55543 - DNA, 586 bp, Homo sapiens
gtcaactatttgggtcatgaccttttgattttataataaaataccacaagatttttatatagtatgtattgtgtcttttgtacacaggttagattattttctctccacaataattataaagttgagactgggaagcttccttcattttgcagatttggaacccgagacactgaatgattaaatggcagagctgccaggcgtggtgactgatgtgtgcctgtagtctcagctactcaggaggctgaggcaggaggatcacttgagccccaggagtttgagtccagtctgggcaacatagaaaccccatctctaaaataaataaaataaatgactgagctgttgtgaaagggttagtgatagagaccagaactcttaactgtcaggccaatgtctttccacttcctcacactgatcccacataactctgggtatgatagtgagtgtcaggggtcagacatgggtctgttcagctgagctgcctgattgttccttataaagtttgtcaacctcttcttttttttgaacaagttaagaggaaaggaattaaagctttatggatgatcacttttcaaagttcttgaagcaa

SEQ ID NO: 55544 - DNA, 644 bp, Homo sapiens
gcagcaaaggatgaagaagggcaaaatgatgaaaggtgaggtggaaagaggttatgagatggtaaagaaaagttaacttctggcacttgattgccacttccgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctc

SEQ ID NO: 55545 - DNA, 493 bp, Homo sapiens
aatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagagtcacttgaacctgggaggcagaggcagcagtgagctgagattgcgccattgcactccagcctggccaaaaaatgtgaaactccgtctaaaaaaaaaaaaaa

SEQ ID NO: 55546 - DNA, 450 bp, Homo sapiens
tccttagagctccagctaatccagatgcaacattgacgaattagtgccggaatgagtatcagcacttgaaaaccctacagagatgccttggtcactccagataagagtttctgtggctgagaggccccactgtatgactcctgtttctgcctgctggacttcactttctggggcttggcatctgatgacctctgtatacatgctgtgcctcctgttctttatgtggccacttcactttgtcctttgggtttcagcttaaaagtagagtcaactagaaatcttcattaccatgctgagactagttaggatgcccctggctcatcagctgtaatgcctctgtcaaagctccactcaaacatgctagaaccatcgccttcccctcctcaactgtaaaccacagaaatgcagaggccctgtctgttttgttcatcagatcctccggagcatagc

SEQ ID NO: 55547 - DNA, 596 bp, Homo sapiens
cagcggagttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgcaaaagtattagttctcat

SEQ ID NO: 55548 - DNA, 633 bp, Homo sapiens
cagcggagttaacggctgcggttcgaagtggctgtgggtattgctgcggctggtgcgtcgtcgctctaggtacgttggggccgggcgagtgtcctgcgagagcggcgattggcggggtggcggctctaggagcgtcggtcgcctctctgagggccggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcctgaggggtaagtaaaagctcgctcttgtccggaatgctttcagaaattaacggataaatctccacctccaccaattttagtgtcccattgccaaattttcttgagttgttttaatcatctaatgaagtcaggtgccagaaggcaactggatctcgcctggcggccttgaagtttgttaaaaagtagggaccagagcatcaggaaaaatacaaaattctgagtaaaatgctgaaatcccgta

SEQ ID NO: 55549 - DNA, 593 bp, Homo sapiens
cagcggagttaacggctgcggttcgaagtggctgtgggtattgctgcggctggtgcgtcgtcgctctaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaac

SEQ ID NO: 55550 - DNA, 867 bp, Homo sapiens
ccagttttctccaagtttggcaagcaagtttgagaaagagaggacgcaataattttttttgccttatttttgttaaaaccttaccgcacttaaggaaacggactttctacctttccgtgtttctgtgttgaaaatgaagtttctaaccacgtgttccttcctttacgacacaatggctttttctgttctgaagacttgcatatggttaatatgtatggaagaagaggacagttgtactgaatagtccacattagaaaaattatgtcatattcacttaaattgttattctagattgcgacttaatactgtttttattatgattttgtcatatttattgtagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgcaaaagtattagttctcat

SEQ ID NO: 55551 - DNA, 565 bp, Homo sapiens
cagcggagttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattgccctcccggagactctgtaga

SEQ ID NO: 55552 - DNA, 543 bp, Homo sapiens
cagcggagttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgcaaaagtattagttctcat

SEQ ID NO: 55553 - DNA, 412 bp, Homo sapiens
tatgtatttcatgttgaggcaagaagtcaatcttatggatgtggtctgtacatatctgcaagataagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgcaaaagtattagttctcat

SEQ ID NO: 55554 - DNA, 430 bp, Homo sapiens
cgtttattctgcaatacgtttgtagaagtgttgactccgatcttaatcaaatttacttcactctcagtcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgtgtttccttgctacttggtatcttgaaatctggtacgaaactattgcatgatccctgcacctttgcttctgcatatatcatagctctcttatagtgagtgtgcacaatctatttcatttgatgtaatcaaagtttaatatattggatagttaaaaataaaatacaactttaaatgcgca

SEQ ID NO: 55555 - DNA, 380 bp, Homo sapiens
gatcacggcagtgtctaattcctgggctcaagtgaaccttttgcatcagcctcctgaatagctgagaccacaggtatgtgccacacctggatgaattctccctttaaaataatataagaatgtttttatgtgtaggccgcaaagctgtagcagtgtcttcaggcaaagctgctaattttatgcatcatgattatcacttttagcaaatacatcataaaaccatgctagaggaaagatttgatttgttcattttctttggaaaataatacaaaaattgtattcatgaagagacaatcatataatacacagtcctataggaaaaatagaattgtataggcatattagggtcttaattaatgaagagtattgtgctgtttttt

SEQ ID NO: 55556 - DNA, 398 bp, Homo sapiens
  misc_feature (20)..(20): n is a, c, g, or t
  misc_feature (29)..(29): n is a, c, g, or t
  misc_feature (52)..(52): n is a, c, g, or t
  misc_feature (101)..(101): n is a, c, g, or t
  misc_feature (106)..(107): n is a, c, g, or t
gaagaaggtggttgatctgngcgacatcntccaatacccctctgcccccggntgcccctggacgtctgcctcaaagctcattggctgagcatcgagggctnccagnncgccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55557 - DNA, 1621 bp, Homo sapiens
ggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggcctcaggaaactgggagaggggggatcttgactgacattttagatcctgtctgctgctcactgattatgactgtggacgcgtctccctgcttctctgggtctgtttcttcatctctaaaataggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55558 - DNA, 684 bp, Homo sapiens
ggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55559 - DNA, 540 bp, Homo sapiens
agagtgaagacccttcacagtcatgttggcacttacagcccctgggatgtcagggaagctggactcatcccacagcatgactggagcctccataggctgtccaggaagggcagctgcatccaggccaatctcatccccgtagctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55560 - DNA, 1022 bp, Homo sapiens
  misc_feature (252)..(252): n is a, c, g, or t
ctctacaggatctgatggagaccaggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagncaggcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55561 - DNA, 390 bp, Homo sapiens
gaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagatgttacacgaagttatgtttatggacataccttttctctgggaaaacggtatgctcccgtctttacacc

SEQ ID NO: 55562 - DNA, 1939 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55563 - DNA, 2219 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggcctcaggaaactgggagaggggggatcttgactgacattttagatcctgtctgctgctcactgattatgactgtggacgcgtctccctgcttctctgggtctgtttcttcatctctaaaataggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55564 - DNA, 1887 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatcttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55565 - DNA, 1967 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaaaaaaacaacacaaaaaaaaaccggggtt

SEQ ID NO: 55566 - DNA, 1971 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaatt

SEQ ID NO: 55567 - DNA, 2149 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaaaaaaaaaaaaactaactacaataataaaaaaaaaagggggggggggtaaaaaattttccgggggggggccaaagtttagggggtcccggttttttgtgggaaaggggggcccttaggggggcgttataaaacagggagggcggggttaaaaaggtggggggggggaatcggcgagggggatttgggagaggacctcgggggggaaatggc

SEQ ID NO: 55568 - DNA, 2143 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55569 - DNA, 2236 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55570 - DNA, 2332 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55571 - DNA, 2122 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggtactggatcccgggctaagctcgggaggaggtcccctttggtggggccatttcgggaaagtatgtcaggacgcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55572 - DNA, 1855 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55573 - DNA, 2077 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaattttcccccaaaaaaaaaaggggggggggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55574 - DNA, 1370 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgtctcaggcaaggctcctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtga

SEQ ID NO: 55575 - DNA, 1088 bp, Homo sapiens
gaggatccccatcccaaagacaggtgataatgctggcgaggatatggagaaaagggaacccttgtacactgtgtggtgggattgtaaattagtacaaccactgtgaagaacagttcgcagttcctcgaaaatctaaaaatagatctaccatatgatccagtgatcttactgctgggtgtatatacccaaaagaaaggaaatcagtataccaaagagatatctgcactcccatgtttgttgcagcactgttcacaatagccaggatttgaaagcaacctaagtacccacctgcatttgaatgccactggcgatcgctggtgctgctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55576 - DNA, 1241 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtattttggaaatgcccactgggccattcccttggttgccacctgggaagtttgtgtcttcagggccaagggcttccctggacttttcctttttttggcc

SEQ ID NO: 55577 - DNA, 857 bp, Homo sapiens
cgtcccctcacccgctgtttcagttctcccatctccctcagtgacctggatctgacctcacaccatcagcagggggcacccaccatgcacacctgtctcggagtaggcagctcagcctgggtcatggaacccaggctggagtgcagtggcatgatcttggttcattgcagcctccgcctcccaggccgaagtgatcatcccacctcagcctcctgagtagctgggatatgtaccatagataagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55578 - DNA, 1181 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
  misc_feature (1121)..(1122): n is a, c, g, or t
  misc_feature (1149)..(1149): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaagaggttgaaagggatgcctccgggaagtttttgggcttgcaaaacctgggccgtttggattgggggtttccaaaggtttcgggggaacaattannaggaaaatcccggaaaaggggattgcnaatcccctccaaatttcctttggggcttgaaa

SEQ ID NO: 55579 - DNA, 1132 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaagatgctctggagcttctggctgcagctgccgtgccatgcgctcccggtccgcgacctcccgcctctgccgctgctcctccccttgcctgctgccccctctccccc

SEQ ID NO: 55580 - DNA, 1018 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
  misc_feature (1011)..(1011): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagaaagaagcaatcccgttgtcaattcctgggacccttaactccccaaacttacccgggggttgaagaaaactccctnggtttct

SEQ ID NO: 55581 - DNA, 1224 bp, Homo sapiens
aatacgctagtagaggctgggataaaatcggacgaggaccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagaagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgca

SEQ ID NO: 55582 - DNA, 1158 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
  misc_feature (1047)..(1047): n is a, c, g, or t
  misc_feature (1059)..(1059): n is a, c, g, or t
  misc_feature (1066)..(1066): n is a, c, g, or t
  misc_feature (1092)..(1092): n is a, c, g, or t
  misc_feature (1103)..(1103): n is a, c, g, or t
  misc_feature (1109)..(1110): n is a, c, g, or t
  misc_feature (1116)..(1116): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaagatgctctggagtttggtgnagctggcgttgntggttcnggttcgggactaagaatctgaggtgntcccatctggngggggnnattccnggttttgaaaggttttgggggaacccccacttattggcttta

SEQ ID NO: 55583 - DNA, 1443 bp, Homo sapiens
  misc_feature (1421)..(1421): n is a, c, g, or t
aagtcccagaggcctgagagggcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaagatgatccattttggtggtgggaatttccagggttcgganacggctgtgggggaactccgct

SEQ ID NO: 55584 - DNA, 2281 bp, Homo sapiens
gaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55585 - DNA, 2095 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55586 - DNA, 2072 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagacagcatttccctatgtcgcccaggctggagtgcagtggcatgatcttggttcattgcagcctccgcctcccaggccgaagtgatcatcccacctcagcctcctgagtagctgggatatgtaccatagataagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55587 - DNA, 2053 bp, Homo sapiens
aactagtcaggtacgaggctggtggtaatcggcagaggccgccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55588 - DNA, 2131 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagaactgtctcatgattgcgtcttcctccgttgttttaggcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55589 - DNA, 1534 bp, Homo sapiens
  misc_feature (17)..(18): n is a, c, g, or t
  misc_feature (31)..(31): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55590 - DNA, 1212 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 55591 - DNA, 1002 bp, Homo sapiens
  misc_feature (17)..(18): n is a, c, g, or t
  misc_feature (31)..(31): n is a, c, g, or t
  misc_feature (980)..(980): n is a, c, g, or t
ctccccgtagaaccccnnctttcgaagcctnctttggcactgctggcctactggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaagatgatccattttggtggtgggaatttccagggttcgganacggctgtgggggaactccgct

SEQ ID NO: 55592 - DNA, 1469 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagatgttacacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgt

SEQ ID NO: 55593 - DNA, 1176 bp, Homo sapiens
  misc_feature (1)..(1): n is a, c, g, or t
  misc_feature (4)..(4): n is a, c, g, or t
  misc_feature (21)..(21): n is a, c, g, or t
  misc_feature (33)..(33): n is a, c, g, or t
  misc_feature (42)..(42): n is a, c, g, or t
  misc_feature (129)..(130): n is a, c, g, or t
nttntgctgcagtcgttttantgatccccgtcngtcgccggntctgcaggcaccatgagccaggacacccgaggtggatatgaaggaggtggagctgaatgagttagagcccgagaagcagcccgatgnncgcggcgtctggggcggccatgtccctggcgggagccgagaagaatggtctggtgaagatcaaggtggcaaaagacgaggagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagaagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgca

SEQ ID NO: 55594 - DNA, 305 bp, Homo sapiens
aggctccccatttgtaaatgtcttgtattcctgtcaagatggttaggaggattgaaaaacgccgttgtattttatttgattttgataatacacttaacatgagatctaacctcttaacaaatttttaagtgtataatgcagtattgttagctatagtgttcaagtgcattgggaggcgctatccaaatgcaaccccttccccgccctcacccccaccccccgtttattgctacttgttattttcatggttgtgctgaatttttccccaaggcaaatctttacctctgcccttgaagttgcatatg

SEQ ID NO: 55595 - DNA, 373 bp, Homo sapiens
attttccatggtagagcttgtctgtttttgtttttgtttttgtttttttgagacagaatcttgctctgttggccaggctgcagtgcaatggcatgatctcagctcactgcaacctctgtctcccgggctcaagcaattctcctgcctcagcctcccgagtagctgggattacagtagtgtgccaccaagcctggctaatttttgtatttttagtagagagggggtttcaccatgttgatcaggctggtctcgaactcctgacctcaggtaatctgcctgcctcggcctcccaaagtgctgggattagaggcgtgagccaccatgcccagctgcttgtctgtttttttaaaaatacagtctacctattgccagg

SEQ ID NO: 55596 - DNA, 177 bp, Homo sapiens
ccatgggcagtgcatcccattaagtcaaatggctgagtccatttaatcttggcactgtctctccccatccttccttacaatggcatatgctttctaatctcttgagactctttaggcccttctcttaccataccgtatctccagaattacttctgatttgacccattacatgaatga

SEQ ID NO: 55597 - DNA, 445 bp, Homo sapiens
ttcttcatgtacactgcaaagggcaacttctctagaagcattaaaagtgtcaattaggttttcaagtaagcgtcatttattcatatatacattcatttgtctttttatttacaaaattaaatcattttcccatgaacattaaaatgggaagagagaacaaagaaaatagagttgaataataataacattgattctggaccagacactgggctggacaataactcgagggttaccttatttatttacacaaagacccgatgaggtacacactaattattttcatctccctattaccaatcatgagactgaagctgagaagggttaaaaacttgcctaagctcacacaactaagaagtgtccgagctgggctttgaacccaaggtttgatcaagggttgtgcccttaactgccataccatcctgcctcacagatctgggttagggat

SEQ ID NO: 55598 - DNA, 336 bp, Homo sapiens
agtagtccttccacacacccaaaaactcttctgtgccttccatgtttcttccacctgcaaagagagcccattgccatatgctttttcatcagctacttggctgtgctctaaagcacatcatttacattcttcacatttgtttatttataaaattagtctaactggtcctgaaacttctatccacctctgagcagcagctatgatggttgagagataaggatcctcaggagggccatttagccagggccttatattcacaaagggccttagttgggtcatttgttcttgccttccaaaaaggttatttttttatgtgtttaaagcatgattttaagt

SEQ ID NO: 55599 - DNA, 304 bp, Homo sapiens
tttttgttacacagatacaaaaaatacatagttatatgccctgatcaagccagagacaagtctggaaaacaagtaaaacaggcatgcgtaatttttgtttttttgagacaaggtcttgctttgttgcccaggctggagtgcagaggcatgatctcggttcactgcaacctccgtctcctgggttcaagcgattctcgtgtctcagcctcccgagtaggtgggattacaggcattcaacaccatgcccagctaatttttgtatttttagtggagacggggtttcaccatgttggccagactggtc

SEQ ID NO: 55600 - DNA, 184 bp, Homo sapiens
tacacaacttattagcttactacaagttcactgataactctactgcaagaacatgtataaattccaagaataaaatataaataaggcattacgaaggttttcttggaaggaagatctgtttgaactgagagataaaacatgaattttaattgttttaattaattattatcacaaaatgaagtga

SEQ ID NO: 55601 - DNA, 260 bp, Homo sapiens
ctccgtccagcctccgcaaaggtttttattaagtcagtctagcatggtaatccagcattggcactgttcccgtgctcggttcagcagcacatatacaaaaaaaaattggaatgatacagagattagcatggcgcctgcgcaaggataacacacaaattcatgaagtatgccattattttttaagaaagaaaaaaaaagaaaaaagaaaaaaatctgttcccttgatgattgtgatatgcattaaaatttggtaatcactg

SEQ ID NO: 55602 - DNA, 633 bp, Homo sapiens
catatcccaaagcccttccaaatagtgatattctccagggcaaggatcctctccaatttattatcatatccctggatcctcctatgacctttggcatagctgttggaggagtgagcagatgagtgagtaagtaactgatcttctcctcacccatcctcagaggaagaccacgggacaggtgtgagtggtgcctcccaaagatactccaaataccaacccctagcacctgtggatgtgactttatttggaaattgggtcttggcagatgtcattaagttaaagatcttgagatgagatccatcctgaatttagagtgggccttaaatcctgataaagagacagaaaaagagaagacacagagacatacacaggagagagccatgtgaagccagaggcagagattggaaagatttatctataagaaaagccaagaactgccagaagctaggagagaggcatgggataaattttcccattcctcacaccattcacaaaaattaacttaaaatggatcaaagactcaaatgtaaagctaaaattatgaaaacccctaaaagaaaagatgggataaatcttaatgacctagcattaggcaatggtttcttagatatgactccaaaagcatgagcaaca

SEQ ID NO: 55603 - DNA, 526 bp, Homo sapiens
cctctgacagagtgtatattcacgtaataatcttacttattgttcatctccctctcactagtatactagtgccattcggatggggtttttttctgttttggttattcctcagtgaatatttgtagactaattaatagcactgaagatcattcatggaatcattcataggcagcaaataagttctaagtacccaaaagtgttactggaggttatcaatatggctaattacatgaaagtttatatacttaatctctaaatagagcaaatctttacagttctacagaaatgattgggaaggaggagccaaggaaaatttctgctatcacaaaagtttccctaggggcgatatagctattgaacttagaagacgtttttattttgccaaaaggtcgattttgctgaccttggctaggtgcagtgcctcccacctgtaattctagcatgttgggaggccaagatgggaggatttcttgagcccaggagtttgagaccagcctgagcaacatagtgagatctcgtctctatt

SEQ ID NO: 55604 - DNA, 393 bp, Homo sapiens
ccgtttctagactctgacatccagccatctcaatattccagagaagaggatgagtgtgaagggtggtggcgattttaaacaaggtgatcaggaagaccttgtggataacttcgggtctgagcacactccatcaggctgccggatagtctcaccattactcccgttatttggaacctcttcactgcaacgtgaccttgtttatagacagtggaattttccagatgctacacaatatgtgacgttgcaacagattgaagaagcaaatatgagaatcatatcttctatggaatcagaaactcaatttgcaaaaatgaaaaacaatgtgactcttctcactattcttttcggatatacaattatgttcaattaaaatgttatttatgtcataaataa

SEQ ID NO: 55605 - DNA, 442 bp, Homo sapiens
ccgtttctagactctgacatccagccatctcaatattccagagaagaggatgagtgtgaagggtggtggcgattttaaacaaggtgatcaggaagaccttgtggataacttcgggtctgagcacactccatcaggctgccggatagtctcaccattactcccgttatttggaacctcttcactgcaacgtgaccttgtttatgtgagtttagctctctgagactcagtttcctcaaatgcaatatgataagagacagtggaattttccagatgctacacaatatgtgacgttgcaacagattgaagaagcaaatatgagaatcatatcttctatggaatcagaaactcaatttgcaaaaatgaaaaacaatgtgactcttctcactattcttttcggatatacaattatgttcaattaaaatgttatttatgtcataaataa

SEQ ID NO: 55606 - DNA, 473 bp, Homo sapiens
catgcacaaaaataattgatgacatcagcatagttatgggaattagacttattagttaattacagaaccagcagagggagcacaaaccctgcataaataataaccatttcttctgggtatcttataaaatagtggtaatggtggaaggaagaaacagattcaaaaactaaattgttagtatcagaaaatgggctttgctttcttggaatggtgttagggcagaaacctaatacattgttcatatggtctacgtataaatgttgacgtcttaggtactgaagagaagaaaaatgtgtgtgtgtgtgtgtgtgtgtgtgtgtgtgcgcgcgtgcgcttctccttgttatcatggtgaaaccctcccttctgtggaataattaaggtcagatggtgaaactttcctagagttggcaaatacttgttgtatctgaccctgatatcacaggagctttcattttagccttgctcatcct

SEQ ID NO: 55607 - DNA, 1052 bp, Homo sapiens
aagcattcggaaccttgattccacaggacagaagataaaagaatattatcaggcaggtaacacaagaaatacaaattcaaaatcagtgcatacagtgcgcagtcttccaaatgaagagatgaatgttaaaactattcagagaccactggtcattaagttgagcaaaaatcaagacgtattttacagcgtaatattgataggtcttaaaggaaatgttttcagtcatataatatgttgacactgcaaacataagcagagcttttgcggtacagtctggcattaagtattacgagagaaaaacattttgcccagagacacttactggggctctatttgctctggaaactattagagaatgttgtatctatataatagaataatattcattaataagaattatttaaggtttggtttataaacttgggcatacataataatgtcaattaaatggcaatataaaaattgtaaatgttgataactacataaaatttttatgtctgttaaattaatatgatatgaatgacaattatttgaagtttctagctcttttcccttgtgagagttgtcagaatcaaaatgaagtcacttgtattaaattctaacaaaaaataaataaagccaggaggttaagaagggagctctcacacacgtctatcgtaagaactgctacaaagcatctctgaagggctcttctgcacatatgcctgtaataagaacttttgccagcagtccctgcatctctacatccatggagccccattgacattccccacctgcagcggccactgcagctcaaactgcagcttgctacgtgagtcacaaggatagctagctggatgcataagaacatttgactgacacagtctcccctgtatccaatgttctctttgttttcaaacaaattccttatgcttttcccttttgcctttaaaagcttctcctggcttcaacctgtttggatatgcctgtggtccctatagccctcatatgctggatttgcaaatcccctgcacactccagaataaactcagttcaataaactctttgaagaa

SEQ ID NO: 55608 - DNA, 353 bp, Homo sapiens
tgtaaaaaaaaaatagaacttttaattcaagatttaaaagtgttcaggtaatgctgaaaaaaattatactgtgccttccactcccccactccctcgcaaggggacaactctaaaacaaaaaatagggctcaaattccatgatcattttactgttttatatttggcacattagatataaagatttcttcaaaattacctctggccattctatagaaaatcagtccattgagaaagaagtggtagtagatattcaatataaccagcaagccaaacgtttaaatttttaaagcaaggaaattggtaaattcaggaaactattctggtgaaactaccgtgtacataattcacaaaga

SEQ ID NO: 55609 - DNA, 354 bp, Homo sapiens
ggaggtgaggggaaggaggcagggaggcttgagagaggtgtccctgcagttatccatctgacaacatgccagttccagagattcccccagtagagagaattcctttccaactgttctgaaaataagaatattcctgagagggccagcccccgccacaggattggtctccaccctgctgtgaacacgtctgtaagctgttgtaagctgactggtagcggagatcctggtacagtaggaagtctgaaggaaggagaaggatattttggcacttggaggagaggaaattcaggaaggagaaatctggctgaggggcgacagagtgggcagtaagacaggggagagagaatagagggg

SEQ ID NO: 55610 - DNA, 363 bp, Homo sapiens
cgtgaataactgcctaattagtggacatgaaaactggacagtctccaaagtcatcagagatgaccacgcttgccaggcaacttactagactaagggtgacgtgcccatcatgcaggaagcttctccaaggctggcgagagcaacttgtctgctttgagaaatgcagatctatcaggatccagaatcggactctgaaaaagctgtcatttcatgtctctaaaacagcctttgatttaatgtacaagatgtcaagaagtaaaggacaataaaataaaaaccaaaaaaggagaactatttcaattaagaagcattcctatatcaattcttggaaatcacataaaataaaagctgtcagaatcaatc

SEQ ID NO: 55611 - DNA, 306 bp, Homo sapiens
tcccattcttagaccccagaaactgggtttatcccaccgaaaaacacaaggactgacagtggcattccacttctcagaagtggctttccaaataataataataaataatattaggaagaaggagaaatagaggctggtcaagcaaggcatctgtccattataccctccttgcctaggtcctcataatctactatctccctccagatttaataaaattgatctaagagtaagtagaagaaaccacatgtacgtgtaagaggtatacaagagggggctatttaaccaatgaacaataagaaaaacaaa

SEQ ID NO: 55612 - DNA, 442 bp, Homo sapiens
aatcattctacctggcagaggtacaggatgagtcaggcaaaagaaatgtggcaaatggactactcacactgagaaagccaagcccatgtctttgaactcttaactttgtgttctttcaaacagaataagagtcagtatcctgccacaatggagaccaaggaatcacggggaataatgttcaatgcccccagccagttgtactagaaaatattgcctggttgataaagtacatctcccacggtttgactccccttcctcttcctggtgccccctctcattgctgccctgggctgtacacagtcccttaagcattacatccatcagatctggctgcctttaaagtgactcatgttccaaatgatctttcctcccatcactccaccagtcctatagcaaaactcctctcagtttccgactcatccatatcaagccagaaattgag

SEQ ID NO: 55613 - DNA, 255 bp, Homo sapiens
gtgttcgcctttgtcttgggacaggatggtggctgggaggtgcaggtctacagtcacaccataagtgggccaagtccttgttcctgacactgatagttactagaggcttggaaggatggagtagggcggtgggagggtggcaggcaggtgatgagatattggttagtgggtactatgtacagttaaatagaaacagtaagttctcatgtttgatagtatagaagggtgactatagataacagtaatatatatttc

SEQ ID NO: 55614 - DNA, 860 bp, Homo sapiens
gattctattatgccatcttgttttttcccccagtctttggtcttttcatgttttcttttttgtacttgctttagaataaattgactatttatattcattgcctaattttctattgacttgtatatttttcttgtgaaaggtaagaattctttatatgttacagttattaatcatttgtcatgtatgttcctaatacttttcttccaaatctatcatttgtgtatgatctcatttatgatatatttttcaattttccaattcattgataaagttaatgatttatacttctgtagttcctggtgttgaagtaatttatattcctggagtatactctacttgatcatatggtagtattcatttgataagttgctagattctgtttagttgtactttatttaggattgctgcatctttatttgttttatagattgcatttctctggaatgaccacagcaatatttccagcccttgatgatcttctagaactttgccacttccctgcatcaagaggtaaaatccatttctattctcttgaattgaacagcttcaatgaattgagtgctgaagaattaacactctgtgacttcatgacttgttggaaattgtgaggaatctcaggccacatggaggggccagtgaagatgttccagcttatagccccagctaaggtttcaactaatagccagactcaaccaccaggtatatgaatgaaccttcagatgattctagtctccagccttcaagcttccccagtcgatgctgagtggagcaaaaaaaggaattattctcactgagccctgtccaaattgcaaatacctgacaaaaataaatattgttgttttaagccactaaaaaatgga

SEQ ID NO: 55615 - DNA, 754 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataacgtgcatataactttgtagagtatcttctaaaattgcatttgacttctgtgaaattattaaatggaagttattgatgc

SEQ ID NO: 55616 - DNA, 3878 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55617 - DNA, 3288 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatacta

SEQ ID NO: 55618 - DNA, 3578 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcatacacgtcgcgagggtaccgagcgctga

SEQ ID NO: 55619 - DNA, 3824 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55620 - DNA, 4462 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataacgtgcatataactttgtagagtatcttctaaaattgcatttgacttctgtgaaattattaaatggaagttattgatgcagtgacaatttctccaagttcctgtcgtctttctctctcttttttttttttccagcctgggcaacagagtgagacctccaactttaaaaacaaacaaaaaaaatattaaaaaactaaataactgaaatgctagtagtgtttatctctgggtggtaggattgtttatttttatacttttctataattgatttttcgcaattaatatttactacatttgtattttttaatgcactttacaaatatttttagcacagacacaacaaatgaaagcaaagtgccaaagagctgggaaagtcaagagactgataatatatatgtagtatatttgatgctaatgtaaatttcacaactgcttgttactacgattatcttggaatcttctgcttaggaatttagatcttgctctttggaatagtgaaagaaatgggatttacccagcaatactacttttaaaacaatttttctcctgtagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55621 - DNA, 3078 bp, Homo sapiens
cggacgcgtgggtcgacccacgcgtccggacccacgcgtccgattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55622 - DNA, 1970 bp, Homo sapiens
  misc_feature (1907)..(1907): n is a, c, g, or t
  misc_feature (1970)..(1970): n is a, c, g, or t
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacaccccccnccaatcggactgccaaattctccggtttgccccgggatattatagaaaattatttgtatgaan

SEQ ID NO: 55623 - DNA, 1943 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagagcgactaagttaagatcctgtagagtcacc

SEQ ID NO: 55624 - DNA, 2948 bp, Homo sapiens
cttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55625 - DNA, 2759 bp, Homo sapiens
ggacctcaacgcgtcgccacgcgtcgtagttctagatcgcgatctaaactggcacagttgacatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55626 - DNA, 1798 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaagggtaatatttttcattgtaacgttctctaatgctgattttaaattagacaaggaataaaaaatacattctcatagaaatttcatgtgaataaagttctagttctctttgttccttttccatttctct

SEQ ID NO: 55627 - DNA, 2565 bp, Homo sapiens
tcccaaagtgttgggattacagtattttaatgcactacaaatgccatgcccttagactggataggtttacaagctgtacgaattgaaaaaatcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55628 - DNA, 1325 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatcagctccttcagtttgtctgtgcatcgataacaccggta

SEQ ID NO: 55629 - DNA, 2368 bp, Homo sapiens
ctacacagtatatgtggatgttctggaaaattcgtgctagtctgctccagtatcgagttcggaaaaacgggtgtaatagttactgggagcatactctaccaaaggatcatgcgtacaggcagatttgcaataagagaacatagaatgatgaaggggacgcatatgcctatccacattataacacctttaattaactcctcataatcgcacgactatgatggcatagtcggaattgacctaggagagcattgcttgactgaccgggaataagacgtaaggctcggagaaggacagggatctatgattgtgaagacacgcggaatccaggcagctagctgtccggagctgcatcgtagaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55630 - DNA, 1091 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatcttgccgccgttcattatcagacacactgatggaactgtattatattaaaatactaaaaatccaaaaaaaaaagaaaaaaaaaaaaaaaaagaaaaaaaaaaaaaaaaaaaaaaaaaggggggggggggaaaaaaaattccccggggggggccaaatttgaggcgaaccatttttgagtaaaaaagggtcggcccataagtgaggggggagaataagcaagcaaggaggaggaggggggggagtaaaaaaccggtgggggaggtggaaaacgttgaaccagtggagattgtgtgaaagagacccaattctggggggtggcacatgttggccaactacaaacagaggtatagactgaggagaaaataaattgaggggtatatggtgttaaccacaggagatgtgtgggaagaaattggacaggactgttaaaatttcgagggataaaa

SEQ ID NO: 55631 - DNA, 210 bp, Homo sapiens
acctacaacagctgtggaagtaagctctgaaacgtggagttgtagaaataacacatttattgttgctacttgatatgagggagttacttgtttatattactttctccagttttataaacagttcaataattttcttatttcttcttttagacaaaatccaaaagatattcacaccctggcacagcttatttctgcttactcacttgtaga

SEQ ID NO: 55632 - DNA, 154 bp, Homo sapiens
caaatcttaactaatttgttagctttggtaagctgataccaagtcttaaaccatgtttatgataagtgcccaactaactcttatagagcacttacttaatgctctataaatattttatcacaaagatggtaatgatttttttttctctttgtag

SEQ ID NO: 55633 - DNA, 2253 bp, Homo sapiens
attcccaggcttagagacatcgtttaaacaaactatcttgaaaatattatgacacatctctcatttctttataatcgttatgcaggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55634 - DNA, 530 bp, Homo sapiens
tctgcccacagaaccctctaaatccccttgtaaatttaactgttagtccaaagaggaacagctctttggacactaggaaaaaaccttgtagagagagtaaaaaatttaacacccatagtaggcctaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgttcctcggcagcagagatatcaacctccaacagatattctcatagtggtac

SEQ ID NO: 55635 - DNA, 3837 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatcatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55636 - DNA, 3882 bp, Homo sapiens
aaagacacccccccccccaccattataaaaaaaaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55637 - DNA, 3824 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaatggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55638 - DNA, 3781 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatcatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55639 - DNA, 3992 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggggcatagaggagtacaccggagggaatagtcacttcttcctgaggacagtgggaagttaggaaaggcttcatggagaagatgattgtgttgactctgaggaagatgaggacgagacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55640 - DNA, 3116 bp, Homo sapiens
tccacggtggcatccatgatgcatcgtcaggagactgtggagtgtttgcgcaagttcaatgcccggagaaaactgaagggtgccatcctcacgaccatgcttgtctccaggaacttctcagctgccaaaaacctattgaacaagaagtcggatggcggtgtcaagccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55641 - DNA, 3070 bp, Homo sapiens
taaattagcggccgtgcagactgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55642 - DNA, 2920 bp, Homo sapiens
tctgcccacagaaccctctaaatccccttgtaaatttaactgttagtccaaagaggaacagctctttggacactaggaaaaaaccttgtagagagagtaaaaaatttaacacccatagtaggcctaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55643 - DNA, 2686 bp, Homo sapiens
gtggtattcgacgtcatgtcacatattgatgagtagaaagaccctagcgcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55644 - DNA, 1702 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagattgacaaaacaacacacaaac

SEQ ID NO: 55645 - DNA, 1396 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctctcttatcaaggacaaatgagcaggtcga

SEQ ID NO: 55646 - DNA, 2393 bp, Homo sapiens
tgcggagcttgattagagatcgggattgtgactcctgacaagatattgctggaggcatatattaagtggatccgggggatcaattcaggttgcccaaacagcacatgccatggccctgtgctgggagtgcagaacgatggcagtgtgaatgctgaaggacagcctatgaatgggagggagtgtgtcaaaccatccggtgagaaggctgctgggggtttctgaggaggcaggcgggaaggggaaggccttgcagatggatgggccttggttcacaaaagcaacaggtaagagagtggctgtggacacggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacctagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaggtgtt

SEQ ID NO: 55647 - DNA, 803 bp, Homo sapiens
gtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataacgtgcatataactttgtagagtatcttctaaaattgcatttgacttctgtgaaattattaaatggaagttattgatgcggggccccaaacaatttttccctgccccacccctataacccctccccat

SEQ ID NO: 55648 - DNA, 2167 bp, Homo sapiens
acctgggagtttgcttaagccctcttcaacaaatacagattgtaattttcacaaaaggaatctttgacaatgtctttttatttgttttttgaggtagggtcttgctctgtcacccaggctggagtgcagtggtacaatcttggctcactatagcctcgacctcccaggctcaggtgattctcccacctcagcctcccaactagctgggaccacaggtgcccgccaccaggcctggctatttttttgtattttgtgtagagatggggttttgccatgttggccatgctggtctcgaactcctgggctcaagcaatccaccatcctcagcctcccaaagtgctgggattacaggcgtgggccaccacactcggccaacaatttcttaagattgaaaaggaaaagcagagaggcagggcctacaatccatgccatcagtggcacagggccctgtgccctggcatctgggttcacgctctgctgttgctgtcttcgaattcctagtgatgtttgaacaaaggccctatgtttgcattttgcactgggccccacaaatcacatggcccatcctgagaagaggagtctcacacctccagtctcctaaatcacctctggaagtttttctcaacgaaagaactgaagctttcctcaaaagttccgtaggggagacagttcatcaccatacccaatgaagaacattctcatacattgtgggtttgaatgtaagagtaatacagacttttcagtgagcagtttggtgatgtgtagcagattttaaatttacctaccctttgatccaataatttcacttctagaaacttgaggaaatgattagataaatttacgtatgtgtctgtgtgaatgttcattgaaggaatattcataagaacagaaatttagaaacagcataaagttctgtactattaaaggattggctaaattttaccataatcacaaagtaattacagtcactacaaccaataacattaaaaaagatacagtaatgtagatctatgtttattgtaacaaagatatccacaggatattgaatggggaagggaggtttcaaaatagtatgcaccgtgtctcactttcattttaaaatgcagctgtgcatttacataaaactaagccaggtatggtggctcacagctatagtcccagctacttgggaggcggaggtgggagggtcacttgggcccagaatttcaaggctgcagtgagctatgattaagccactgcactccagcctgggcaacagagtgagacctccaactttaaaaacaaacaaaaaaaatattaaaaaactaaataactgaaatgctagtagtgtttatctctgggtggtaggattgtttatttttatacttttctataattgatttttcgcaattaatatttactacatttgtattttttaatgcactttacaaatatttttagcacagacacaacaaatgaaagcaaagtgccaaagagctgggaaagtcaagagactgataatatatatgtagtatatttgatgctaatgtaaatttcacaactgcttgttactacgattatcttggaatcttctgcttaggaatttagatcttgctctttggaatagtgaaagaaatgggatttacccagcaatactacttttaaaacaatttttctcctgtagatctttgccgccgttcattatcagaagacactgtaagtattccatcattgttaaacctaaattttacacttctgactatgatagattactgaggcttcattgtactatttattgactttttttagaagatggcaattcattaagtaggaatcacactagaaaccaccctctagtatcagttatttgatgaagtctactagagtgagaaatcacaatacaaaaaattttgacataaccttaagcacttgattatacatttatataatgtaaatttattcccccattttaggatgtaggactaaggtctttgaggactggtctgctcctaggagttccatgtatatttcttatgtagtgacataattcaacattcccaatttacacttttggttttttctttttaagtgtaacaatatcttaaatacagttggtaagcacttccattatagagtccttatgttttttttttgttgtttgttttttaccaatctcttaccatttttc

SEQ ID NO: 55649 - DNA, 1946 bp, Homo sapiens
  misc_feature (1944)..(1946): n is a, c, g, or t
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcgttggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagagaannn

SEQ ID NO: 55650 - DNA, 1229 bp, Homo sapiens
gcatatttaggcaagctccctgtgcaagttcccttatctgcacaaaacatctagtttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactcttatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcat

SEQ ID NO: 55651 - DNA, 715 bp, Homo sapiens
gagcagtggtttgtagttctccttgaagaggtccttaacatcactcctaagttggattcttaggtattttactctctttgaagcagttgtgaatgggagttcactcatgttttggctctctgtctgttattggtgtataagaatgcttgtgaattttgtacattgattttgtatcctgagactttactgaagttgcttatcagcttaaggagattttgggctgtgacaatgtggttttctagttacacaatcatgtcatctgcaaacagggacaatttgacttcctcttttcctaattgattacccttaatttctttctcctattcaatatttttttctagtactatactttacagtttctatgttggtaagtatacaatgtgagtaattttgaatttactgtcatcaaatatgctgttaaataatttgtcagataattgcatcaaatcattcctaggaaaagcaaaaccaacagtctgaattcactattgacacaaccctgagatatgctctccttctcctgctgaagcacccagaggtcacaggtatgatcacagaggatgagttaattgagttttaggaaagatgttgggaaggtgctgctagtgttctcctttctgtttctcttagagaagttccattatttaaatttctgtgcccgcagctgtaatctgtcccaatttaatggtgtgattaaaatggaatatcctggcct

SEQ ID NO: 55652 - DNA, 2534 bp, Homo sapiens
  misc_feature (2532)..(2534): n is a, c, g, or t
ctcgtgccgaattcggcacgagaacacaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcagctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcgttggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagagaannn

SEQ ID NO: 55653 - DNA, 2272 bp, Homo sapiens
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcat

SEQ ID NO: 55654 - DNA, 2422 bp, Homo sapiens
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcat

SEQ ID NO: 55655 - DNA, 3069 bp, Homo sapiens
  misc_feature (3067)..(3069): n is a, c, g, or t
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcagctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcgttggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagagaannn

SEQ ID NO: 55656 - DNA, 562 bp, Homo sapiens
gcaaagaggggaaagacgcaggggtccccaaagcccttcttcactttgtgtccccttgctgcgatcatggagagttaaagaggcttccttgggagaagagctctgccaccagggcttccccagtgtctttgggggtctgtgaaaaagaggatcctctgaggtttactgggagggctcaaggctgagggaatggagaggaaaattttagcagttccatcccagtgtaaggaccaaccccaaaagttaaacttgcaccacagactaaaggtcaagggcatcctgtgtttctcccctttcttccccagagtgacaagggccagttcagactgacagaaatccaacagctttcctgagctggaaatttcagaacagtctgcaagttactcccaggtgactgaaggtcaaggtgaggcccccctgcctctgcctgcgagtctcccccggtttgcatttttcttgacaccggcatttcctgaggttgagctctctggggagttctagagaatggctagtaaggctttttgagcttgcacatctcacctgcctttcctgtcttttgcct

SEQ ID NO: 55657 - DNA, 319 bp, Homo sapiens
tctttttccctcctctgacttcctgtcaggaaaaaatgtattttttttaagttacaaatttatattagcagtcatcttgaataacttctttctaagttctacatctgctatttactggttgtttgaccaaaataaacagattaatctgagtctcagtttctttctcttaaaatggatttaaatacaacctaataaatatgttctatattaataagcatcagctatatgctaggcactaaactggtaacttatctactatctcattttgcccttaaagtaatcttatgaggtaggaattattatccccattttattgaga

SEQ ID NO: 55658 - DNA, 811 bp, Homo sapiens
  misc_feature (2)..(2): n is a, c, g, or t
  misc_feature (5)..(7): n is a, c, g, or t
  misc_feature (9)..(10): n is a, c, g, or t
  misc_feature (12)..(13): n is a, c, g, or t
  misc_feature (15)..(16): n is a, c, g, or t
cnaannncnncnngnnaaaaacatttcatagataaggacacttctcttagcgaataccagtcatttatttatagagaagccagtctcagcgttctggggagatcagctccagcgactggctttatttcccaggagtatctccattgtgctggggaggcatgaagagcaatttcactgcttagttcctctttcttctgaggaggattgaaatctctcatgctaattatggattattttctctcagctctgcaggttttgcttcttgtatttgagaatgttataaggtgcatgcacttttaggatttttacatcatatttgtaaatttgaccccctttatctccagtgacattctttgttgtgaagtcaccttggtctgactactctcctttcttctgatttggtgtttgcgtggtgtgtttgccaagtttagcttttttcactttcaacctttgtgtatgtgtaaagtgcatttctttcaggtatcatataattaggtcttgcttctttattcaccctggcaacctctgttttttatttggaatctttagactacttgggtttaaatctatcatctctggcgttttcagttacatctttcacttgtcactgcccactctcaaatggtattacactgcctgagctgcggggcagtgctctgactgtagcttcctgcttctgacatgttcttggttggcagtgttgctgtgtcatgtccaagtgaaacatggtataaaccccacaatatgatgtttttgtttttgctttaaataggcaattacattttttcccctcaaatttgaaaagagaaaa

SEQ ID NO: 55659 - DNA, 354 bp, Homo sapiens
tagaatgcaaattattttaattcagaatgtgtatttcttagtctcttctttcagtatttaccataatttattccatttacttaacaaacttttttgagggcctatttcctgagcactgtgccaagtgccagagatacagaaagaacaaaacaaccctgttgcaaaggattcatggtctaaataaatgaatgcatagaggtacatttccacttttgttcgtttcatgtggattgcacatatcctgtcaaacttatatcaactatagctaatagggaaattatgaagataatacaatacttattaagacaatttagaaaagaaagtcatctttattattcactttcaaaattttat

SEQ ID NO: 55660 - DNA, 297 bp, Homo sapiens
gtcatcacacttggcccctacaaatacctctcaatttcagcagtagagccagccccagggcctgtcccacaaccctggcccactttatctatcctaacgaactcaacaaccacgtctgtgtgtacatccatccacccatccactcactcattcattcattcaacacattttaaggagtgtctactgtctccatacttcctccccaggctcccccaaagctatggattcctacataccatgggttacttgatgtctccacctgggcctgccatgatgttgtaaaaggccaaaccagac

SEQ ID NO: 55661 - DNA, 253 bp, Homo sapiens
tccaggaaggtggatagtatgccagcagcggcatgctgagagaccatgcaattagggtgccagagccctatggggtgatgaggagggagtaccagcaccctcccagcagaggtaggaagaaccagcaacacgcaggcacaagtccatgtggcactgcactgggagatcctcggctcccagatggacccacccaagtgggcacccccggatcccagaagagggactggatggaacctgagggcagagggagtaa

SEQ ID NO: 55662 - DNA, 731 bp, Homo sapiens
acttgagggaggaaagtgcaggacaccgaggggacctgtgtcttgtgtttcagatggctggagtacagtggcacgatctcagctcactgaagccttacctactgggctcaagcgatcctcccacctcagcctcgcacatagctgggactacagtatagaaacttgatacctccctgcaagctgagggagcaggctccggccttggccagcccagaaaggggatcccacaatgcagcggtgggctgaagtgttcctcaagtgccgccaaagtgggagcccaggcagaggaggcgccgagagcgagtgagggctgtgaggactgccagcacgctgtcacctctcaacactgcggtgctgataatgacacttcctgataattaggaatgtggagccaagatggccgaataggaacagctccggtctacagctcccagcgtgagcgacgcagaagatgggtgatttctgcatttccatctgaggtttttcccatggtgttccctttccaatgtctttctggaagtcacacattgaccactaacaacaggagagaggacaaagaaaggcagcaaaagactatttccaatgcgaaatatgatcagttcctgcttcctggttgctgtgaggattcaatctaataatatatattagaatgttcctgaacctctaaaaggcttaaaaaatcttgacaggcttactgttattctaataaatgttccaaataatagaagttt

SEQ ID NO: 55663 - DNA, 245 bp, Homo sapiens
tatgctatatgtagattttgtaatttatttttattccacatgattcttataagattagtctatttggtttcttttgaaaaatgtttgtatacattttttatattgagaaaacatgtttgtatacaatattcataaaattatggataattttagttccttcttattaaatacaaaatggttaatattattctaactttgtctttgccttccatcaggttttgattttcctgattgaatttataact

SEQ ID NO: 55664 - DNA, 689 bp, Homo sapiens
atgacattttgtgttggtccttcctcttgagtgttgaccatttccctgtcttaatccctaacccaaggcctggtgctcttataacctgctgtgctcttccatgttctccctactaagatgagagactcatcaatttccctgacaggtccctgagatgccgtcaccaaagtctggtttcttaaatgatgacctggttaatacaaacaagaatgaaaaaagacccccacaactaacatatatcgggcacttacaaagatcaggtcctgagcagtgcttttaacttttgtacagtactcatcacaaacccatgaattaaatattattttggtatgaactgctagttgcctacccagtattcattctcccattcacagatgttaaagactacatttcccagctttccttgcaactaggagtagccaaagaatataaatagaagttgctgggtaagcttcagacaaagctctttaatgctgatagggtgccttttattgctgtgaaatattggctgcagtgtagacatgatagctggagggcaccttgtaaccatgaagtaactttaggatggaagccatatgcgaagaatggtggaacagaaacagagaaggagcctatgaccctgatggctgtggagctgctacagtgccttcctccagactttttataacaggcaaaataaatctctaact

SEQ ID NO: 55665 - DNA, 465 bp, Homo sapiens
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaa

SEQ ID NO: 55666 - DNA, 342 bp, Homo sapiens
aaggttttagtgatgattcagtgagaaacatatttgaagcaacaagcacagtaactggaagctgtaggtactcaataattgtcagtttccttcctcttctaaaagctgtgctttcaagtcaattgtatgtctagagtcgcactgtctggtacagtggccagtactagccacatatggctctcaagtactttaaagagggctagtctgaattgatatgtgtcatacatgtaaaatactttaaagagggctcatctgaattgatatatgccatacatgtaaaatacaaatcagatttctaaaactttgtaccaaaaaataccataaaataacttactaataatt

SEQ ID NO: 55667 - DNA, 205 bp, Homo sapiens
gagggcagagggcacgtgccagctatattgtaaggaggttttcctgaagctgctatacagcacttacaacttagtggccaaaaccgagtcacctaactacagctagctagctgcaaaggaggctgggaaatgtagtcctaattgtgagaggccgtgtttctgtttttaaggaaggagagggacatattcagtggaaactaacaaa

SEQ ID NO: 55668 - DNA, 451 bp, Homo sapiens
ttggtcccttggagttcacagtctaatggggaagacaggatataagcaagtagtttcagcatagctttggaattgcatgcagagaagtgagtgaagtgagtgagggccagccaaggctggagtaaagtggcatgatctcggctcactgcagcctccgcccccgccaggttcaagtgattgtcctgcctcagcctcccgagtagctgggattacaggcgcaggccaccatgcccaggtcacccgtacttcatttaccagtccttgctaaggattattcattaaaacactcaacagcaacaataaccacaaaagcaacaataaaaatacctttgaactcactcaatcttgaactattgaacatgctaagtccgtgtcattggcctacttaatcagccctcgattgtaacttgaagaagcttattgataagaaaataaacttctcataaagtat

SEQ ID NO: 55669 - DNA, 599 bp, Homo sapiens
gaagatcacatggcagagtgagctggagcgaggtaccagcagacctcttaggcggggcatgcaccccccgcagtgtcccatgtccccactgttccctgtggctatatccattccacttgacttacttttactccttgtccaggtccttgtggcattgttctttcttttttgagacagtctcactctgtcacccaggttggactgcagtggcacaatctcggctcactgcaacctccgcctcctgggttcaagcgattctcctgcctcagtctcctgagcagatgggattataggcgcctgccaccacgcccggataatttttgtatttttagtagatacggggtttcaccatgttggccaggctggtctcaaactcctgacctcaggtgatccacccacctcagtctcccagagtgttgggattacaggcgtgagccactgcgcctggctgacattgagttttcaactcttcatctacaccatatgtcagagcatttccttcttcttgcaatgacagcaaaaatactgaggcttcaattacttaccctcctctatttctgttttattatctctccctgtcgccatttccatgcactgat

SEQ ID NO: 55670 - DNA, 423 bp, Homo sapiens
atacacactagtttttacttttttggcattagaaattgctgatatagttttacaatttttacagaaaaatatactagtagaaaacaaaataaccagaaaaacataacacagtcactaaaaaatgtttatattactttaataattttaaatatatttaaatctcatatatttaaatattttatgtttcttgtagtactgaagtttcataggcaaacccgtcatctatatgttttttgtaatctagggaagattatgcacttcatgccccctgagagtcagatgttatgaaaattctgtgaattccgagaatggatctatttcggactggtaaaatttccttttctgctttagtttctcagcttgcccccactttttagttaagaactagtacttgttggttgccttttaaaaaataatgtattt

SEQ ID NO: 55671 - DNA, 751 bp, Homo sapiens
tgatgatgttacaatcctattggtgataagtggtttagaaatgaacccttactgaccccactggctaaggcaggaccacacatagaatccaggaacattatttcccttaaagactatttgttcttgtagttcccaaatctggctgatcatcagtgtttctggtcatttttaaaaggacacatatctgagtccctactccactcataacaaattggaatatgtggggagagtggcttgcaatatgtacttttctcaaactaccctcatgattttatgttcatctagattggaaaccttttatctagtcaaactagtcatatgctgcaccagagagcagccaaaaaactgcctgcccttgccagattttccacgggagtggtggttgtaaataagagaaaacaatataaatctaggtcaagatggaaaacaaaacatttaaaatggagatggattatgcatttcttcccatgttttgggtttaggacaatcacgtagcagcacaaacacaataattcaggaccaaggtcaacgccttttctctactcttatcccttgttcccatgataggctttgcttaggaatccattgctgtctttgtagaatcccagagagggaaaaccacttgcttaaatctgtgcagtaagtcagtggcttatctggcactataattgatacataaatgtcctatatatgtgtaaatatctgtcaaggatcattaaattaatagataatgactgcccccattagaatt

SEQ ID NO: 55672 - DNA, 680 bp, Homo sapiens
atatttattagtgacatagaatataccagttattactctaggtcatgagagtggtgataaataaaatgaatccgctcgccatcagtatatgccatgtaacagtttgcagtgactgtgtaccaggcctgtgaatttctgtatgcaatttcaataatgatcctgctgtatctgtggtatttaaaaacatatacatctctggaatctaaaattgagaggttataagtaaaacccagtattagaaatttagtgctggaaatcagattgcagtttaaatctgagcatatagaaagtccctttcttctatgtcagcagatgccttttatgtgaggtttaggtatactgcattatttgacataaaccagtgtttctgccctatgtcttcagaatgacaattctttatgaaactaatagaagaacagaagacaattgcaaaatcatgatgaagatactaattgctttagaattaaggaatacaaaaaataatgtgagctacagttatagggatcataaaagttaaaatgggaatgtatttgagtgtttattatgtgatcagtgctaagaagagtcatcatttaattttacacttaacagtaatcctgtgaggattatgctattattaaatgcatttgatatattacaaaaaggcttacggttggtaaaaattgacccaagtagaagag

SEQ ID NO: 55673 - DNA, 278 bp, Homo sapiens
gggccagccaaacctggggcgggggcccagtgtccccagggactggcatctgagacctccactgtttacacaacaccacacccgaggagtggattgcccagagtatgcgtgcgcgcacacactgcttccagcatacacacgatgcacacttgcatgagcacagggtacacacacatgttcacaccagcactcacacacaggcacacaccttcacacgtggagggcacacagcacactgccttgcatgacatgcacgcccattcacaccactgtgtaca

SEQ ID NO: 55674 - DNA, 1705 bp, Homo sapiens
agtgaggaaactaaggaagagagtagggtggatagataaaggcacagacctcgctcagttactggccaggaagcccagaacctaatggtaccctcattattcagaaactagccatgaagccactgtccccctagagctactcaagacaggacctaagtgaggttgaatgctgctttttctaatcatttaggggatatatactttctttctttctttctttctttttttgagacagagtctcactctgtcacccaggctggagtgcagtggtgcaatctctgccttccgggttcaagtgattctcctgcttcagcctcccgagtacctgggaccacaggtacatgccaccatgctcagctaatttttgtatttttagtagagacagggttttgctatgttggccagactggtctcgaactcctgacctcaggtgatcccacccgcctcagcctcccaaagtgctgggattacaggcatgagccaccacgcccagccgggggatatatactttcaatttcctcaaatagacaaattttgccttataggcacaaaatattggattgtggtgacataacccaataacatcttctcttctgggaaatacatatatcggttacaaagaaacaatgtatgtcagggaacaaagagaaggcttgaagtttccctgtatcttatataagacttaggaagatgacaggattgacctaaagttctgtgtccttgaaggtgagttgcctattaaccccatgatgctgactctgctttgaccctgaggagcctaatcaattaggacaggggtgttcaagcttttggctttcctgggtattggaagaagaattgtcttgggctacacataaaatacactaacactaacaatagctgatgagctaaaaaaaaaaaaaatcgcaaaaaaaaaaatctcataatgttttaagaaaaattataaatttgtgttgggcagcattaaaagccttcctgggctacatgtggcccacaggccacaggttggataagctcgagttaggattatcccagaatgtgagatggcctctgtttctcagcacttactcttgtgaccatagttcctaatcctctcctttactaaagcttctaaggaggaatgtctctctaggcagaaagtgtaaatgaattactgttatcttgctaatactagctactactatctttgcttaacctaacaagatgccagtagagactgccctttaatcatgaaagacaactagagactagtctcattatggcatattctctataagtatcactgactccagaaggactcaaactgataaaaggaacatgctcttatactacattttagttctgttaatgagtttcagtttaaataaatctttatctataaatacagtgatagaatctttggaatcttctagattagatattgaaggctctagtacaaagaatatactgttgtactacacagagtcttgtgcataagggcttctgttattatatgtgttgaatccaatgcaaaatttgcctccatcttcaaaaaagttctgaaaaagaatatctgcctcctctaggagttacacacaacctgaatacatctgtaaggctctttcaaatttccagagcaatgacctttcttgctttttaccagcgaagtaaattgctgaaaagctaggaagtctttctgggttccagcgtatccaagattaaaata

SEQ ID NO: 55675 - DNA, 175 bp, Homo sapiens
ctcctgaatgagatacaagggttccagagccttcgccaggcaccagctggtctgaatgaactagaagtttgacgactgtcatccctggcccacctgggcagagcacaaggggccgagtttgaatgtcatcagcaggttcagacatcagcgctgctcatgtctttagagactgttt

SEQ ID NO: 55676 - DNA, 161 bp, Homo sapiens
attagtatttttgtctgtatgtcctagcactgttcaacaacaaatttttctagttcttgttaatttttatttgttatacaatggaagcacaatgttataaggaaaggtaattttaagctaacaaccagtgcacagcctcaggttttaaattacaaccacag

SEQ ID NO: 55677 - DNA, 535 bp, Homo sapiens
tactgttatgatttttataaacacgctttaaaccaaactaggccataaatcaccttggtttcagaaaaagccaaaatactgacacaatcttttattttcctattaaagtcaagaatgtgttaagccgaattaattgaaaaggaattgaagctcatttcctaagacacttctattcataagtcaaacagcattacctaactcctagaatgagagaatttctgggcttggagatcgcctagtgcaattcactcctttgatggaaaatcgaaccccaggcaggcgacaggccaaggtcacagaggcaaagcagggatgggaaccagcctccctgaacctgtttctgacaaagggcgaggttctgggcccacacacaggcaggccgagctcagtatctgacggtgaatgaatgaagctaagtggtgctccccacagggcccggctcttgtaactgcttcacagacaagcgatttccaggttatggagacatcctagcacagaattaaacgcttcaaactcagactgttaactcctcaga

SEQ ID NO: 55678 - DNA, 794 bp, Homo sapiens
tagctgagcagccctggggcttggttctatgtccctgtggctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggttttgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacacggtagacttattttacatatgtgaactaactagttgtcaaagccaaatgccgattgtattctgcaggtaaagtctttgtctctctgaaatttctagggatgttcttaagggtgaactcatattgacacatgagaaatttaggtacaagaatggtggggaataaagcctggggaataaaacagggcaaacaca

SEQ ID NO: 55679 - DNA, 634 bp, Homo sapiens
  misc_feature (346)..(346): n is a, c, g, or t
  misc_feature (361)..(361): n is a, c, g, or t
  misc_feature (392)..(392): n is a, c, g, or t
  misc_feature (421)..(421): n is a, c, g, or t
  misc_feature (633)..(633): n is a, c, g, or t
aggccaagagaaggggatcactagtctaggtaaaagcactcctgtcttcctggcagcagttggacctcacaatgtggattgttacctcaccctgcaaagttgatgccctatcgccatggtgacgagattagggatctcctgctcttggtcctaagggccactgcctgtgctgtgtttttcaaagaaaatatgtatcttggctcaggcctgtaatcccagcacttttggaggccaaggcaagaggatcacaagctatgtttccagtgtcctctgggtgtttccaagagcaacaagaaacgaataaatctctgccataggagttttagccaattcagaggccttgctncccacaatttggaanattccttggattgaccaagtcaggaagagangggagaaaagtgaaacaacaacaataaanccccaagcataaacaaaaaaagagttaagcaaaacaacaaatgcacaattcatatgattactgagtgttctaatggtaaggagaaactaaaagcagaaattaaaagcagctggtgagtaatctttaaaattttaggtcattaaggaaaaattttaagacaaaactctaattcagctacttacctggaaacaaggctcaggctggggaatccng

SEQ ID NO: 55680 - DNA, 294 bp, Homo sapiens
  misc_feature (31)..(31): n is a, c, g, or t
  misc_feature (52)..(52): n is a, c, g, or t
ttccaacccggggggaaaaatgcggcctttnactgaagaggagacccgtgtnatgtttgagaagatagcgaaatacattggggagaatcttcaactgctggtggaccggcccgatggcacctactgtttccgtctgcacaacgaccgggtgtactataggaggaaaaaaggtcacagctatgtttccagtgtcctctgggtgtttccaagagcaacaagaaacgaataaatctctgccaccctccagggtgccccgacttcactttccctgcagattggaggctaaggaggctc

SEQ ID NO: 55681 - DNA, 504 bp, Homo sapiens
  misc_feature (95)..(96): n is a, c, g, or t
  misc_feature (216)..(216): n is a, c, g, or t
  misc_feature (231)..(231): n is a, c, g, or t
  misc_feature (262)..(262): n is a, c, g, or t
  misc_feature (291)..(291): n is a, c, g, or t
  misc_feature (503)..(503): n is a, c, g, or t
tgcgggtcggtgcaagggcgaagaggaacccgtgggcctcaggggatcccggggggcctggaccagatgtttcgccttagtttttgtgggaagcnnatgacgcgtgggcgcattgcgggcagctatgtttccagtgtcctctgggtgtttccaagagcaacaagaaacgaataaatctctgccataggagttttagccaattcagaggccttgctncccacaatttggaanattccttggattgaccaagtcaggaagagangggagaaaagtgaaacaacaacaataaanccccaagcataaacaaaaaaagagttaagcaaaacaacaaatgcacaattcatatgattactgagtgttctaatggtaaggagaaactaaaagcagaaattaaaagcagctggtgagtaatctttaaaattttaggtcattaaggaaaaattttaagacaaaactctaattcagctacttacctggaaacaaggctcaggctggggaatccng

SEQ ID NO: 55682 - DNA, 366 bp, Homo sapiens
caaagtcttgctcccaggctggagtgcagtggtgcaatcacaactcactgcagcttcgacctcctgcgctcaaccgatcctcccatctcatcctcctgagtagctaggactacatgcatgcaccactgtatctggctaacttttttattttttgtagagatggggtctcgttttgttgcccaggctggtctcaaaactcctgggtgcaagtgatcaatttgcctcagcctcttgggatttataggggtgagccaccaggcatagcataaaagcatctgataaggaaacatctacactgtttcaccgcaaactgttccccattgattttagcactttgattcttgattgaaacaattgttactacta

SEQ ID NO: 55683 - DNA, 727 bp, Homo sapiens
ggattttataaaaggagaaaatataatcgttctctcatcaactgtagtagaattggagagaaaagaaaaccttgaagaactaattgaataatataataaaattactgttagcaatcatactttagtagtgtgaagggaaaagctatttctgcacaggtaggaagcagtattaacaatcaaatacaacttttaggctcagaatataggttcagattatttgttgtgagaataatgagaatattcagaataaaggctaattcttggaaatggattttagaattttcaactgatttcatcagcaaaaacataaggctttcatttcataaaaactttaaaaaatgtaactatgtcatcctgttagtgattaattcaactgtctaaaaattacaaatattttactttattgaaggtttatagtaaaatacgtgtgtgtgtttcgaaggctgggggcttggtggatttattggtgcccttattcaactttgcaatagtcttccatagtttggacatgaatgtaaattgaactgttttaaaaatagtttacatcattgcttgtgcctatcttttgaaatatgtcaacttcctcactatcttgagaagataggctaacacattctatgtgatggaaaacttttcaaagctgtctttcacatcccaggatgtgtaaagccctgcccatagcttcattctctggcagaaatattataccatttacccacatagataa

SEQ ID NO: 55684 - DNA, 517 bp, Homo sapiens
cctcagaatatctacctgcttggggtctggttgggatttcctgggatgtgtttgcatatacgcattttgcaactgagagctgtcttcttactcaggggattgctcaccatgaccccagagctccctgcagaacctcctcccaaagcagacagaatttttgccatctccgtattttcctcaagatgagggatggtgatccagggaacaggaaactgaccggaaccaaagcagtagctgctgagggagctgctactgccagccaagctctcaggggatacaagagaaagaagacatgttccaggcttccagggcttaaacaaacaagataagaagaaactgatgaaaacttaatttcctctgaaatcttgtgtataagttcaaaataataatagaacttgtctggaatgatcttagagaatcttacctgctctgatttccacgagaaggtcatttgagggggcaggggtaggccacatttcatctcattagaataaactccagttacatctccagaaaa

SEQ ID NO: 55685 - DNA, 325 bp, Homo sapiens
cgctctaaacctcttaggtattccggaaatgaagacagtcatttcaggcctgtgttaaatctgcctccgcagtcttccaaggggtaagtagccctgccttttccatctctgttgttcttccctctccctcatgcactgaagggagagtctctactgccaggtcagtctgggcacaggtttggcatagagtgagcaggtctggttcacacacttctattctaacccatgttaccagacactctattccttccacttcagccacttcccacccagaggtgctgagcaggccatgctgtgggtgtgtggcgtgcaccccctcccaccc

SEQ ID NO: 55686 - DNA, 610 bp, Homo sapiens
atattactttcctagactctagtcatgaacaggatgttggaagtcagaggtacagagaagctgcctttttaggccgctcacatgaaagccagccatctgggcaacaagaaaggcttactacagttagataaatttaaccccttctctgacctggcaaggacaaagtacactggcttctgaagaaactttttcttgggagcaaggtagttatttcaaagcacagaaaaaggcggcggggggcacagagaagcacagagaagcgggggcagttgcacaggttgtttattctgttgatggatattggactggagtgatgagtgttctaggatgggtatttgatgatgccaggggactcaagtaatggctttgcatgaagattacacagtaaagctgcacattgattacctcatcttattagctgatggagatgtttgagaggacaagattgcagggctttcaagcctgtacagctaccaggatttgatcctaagagcttgatcattgtcattgcccatagggactgtgttaagaatagtggtggtttactacttaaacgcatgagagtgttataacagttccctatgtcttttgaattgtttagataaggtta

SEQ ID NO: 55687 - DNA, 7581 bp, Homo sapiens
acctctggtggtggctggctactcggatacgaattcggcacgagggcaggcgtcggctagtgtcgggagtcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55688 - DNA, 7789 bp, Homo sapiens
acctctggtggtggctggctactcggatacgaattcggcacgagggcaggcgtcggctagtgtcgggagtcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggatctcactttgtcgtctaggctggagtacagtggcatgatctctgctcactgcaacctctgcctcccgggttcaagcgattctcgtgcctcagccttctgagtagctggaattacagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55689 - DNA, 7724 bp, Homo sapiens
ggctaggtagcgaggctgggtgttcaaggacaaagtacactggcttctgaagaaactttttcttgggagcaaggacttgggggtaacaaaatgaggagtaagtgaagaaagaagaaggcacagcttgtcgagattgatggaccgccccccgcccccgggagagcagcgtaggaaattgcaggatgaaatttgtgtgccagtcttgtcagcacccattcctgttgaaggagagggcatatggatgaggcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55690 - DNA, 7752 bp, Homo sapiens
acctctggtggtggctggctactcggatacgaattcggcacgagggcaggcgtcggctagtgtcgggagtcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagccaagggtcatcttttgtttctgaagaaggagaggaataccttctactagaagattttgaaagcaaaacgattccattgcaaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55691 - DNA, 6827 bp, Homo sapiens
tacatgattagaatcgagctggtaccatggcatgtagtgaggacagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55692 - DNA, 5939 bp, Homo sapiens
catatcgtcgaccaggccgtcggattcacaaggcgataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcattttttttaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccat

SEQ ID NO: 55693 - DNA, 533 bp, Homo sapiens
acctctggtggtggctggctactcggatacgaattcggcacgagggcaggcgtcggctagtgtcgggagtcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagcatggaagaggagatggttcgtgttacgcagtggcgctcgtatgag

SEQ ID NO: 55694 - DNA, 452 bp, Homo sapiens
ctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccaggtaaattatatatgcccatgtgagagagagacagaggcgtgtgtatgtgtgtacacactgagattcttacctttaaactttttaaatttcgatttgcaggcttgaaagagaccatctgtataggcatatgtttcaggctttatatttcaggtttacattcccctattgatttccgatattcaggagattgtatcgaagagacacaatctctgccatctttggcaaagagcagttttccctacaaggctcttttggaaatctgtctcctattttgtagtct

SEQ ID NO: 55695 - DNA, 410 bp, Homo sapiens
gcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggtaagttcaagatattactattcaacttgaattcttcttttctgctacatttccagaaatgtcatacaattctttgttattttagttacacaatataatgttttatttttataata

SEQ ID NO: 55696 - DNA, 1563 bp, Homo sapiens
acctctggtggtggctggctactcggatacgaattcggcacgagggcaggcgtcggctagtgtcgggagtcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgtttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggatctcactttgtcgtctaggctggagtacagtggcatgatctctgctcactgcaacctctgcctcccgggttcaagcgattctcgtgcctcagccttctgagtagctggaattacagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttgtaagtataattgaccttggcatcatcaagtgtatttcattgtc

SEQ ID NO: 55697 - DNA, 269 bp, Homo sapiens
gttaggtcattcacacatggtggagacaggaatctacagaccagggatcagccccaaggctatgatctttgtgctgcgccgctctacccctgagcagacaggccagaggtccagagagggctgtgctggcagagttcatactttgataactgaaccctagagtaagcctgccctggaaatgccagctcaagggactgacaggcataatgctctttgggagagaaatgccacatctgcagcgacacgcatcctaacactgtcccaggact

SEQ ID NO: 55698 - DNA, 532 bp, Homo sapiens
tctacaaacctagatttatccagaatgcaaccacttttctcaacattccctttaccaccactttggtcctagccaccatcatgttgggttagattattgtagtaaccttgcttggataattataatagtgtcctaactggtctcctggtttctgctcttgccccctgcagtctatgcccaacatatcaaccagaatgatcctttaaaacttaagtcaaagcatgtcagtcctctgctccagaccctttaaaggattttccagttgagcgcagtggcttacaccagcactttgggaaaccaaggcaggcagatcacttgaggttaggagttcaagaccagcctggccaacatggcgaaaccccatctctactaaaaatacaaaatttacccagatacggtggtgtgtgcctgtagtcccagctacaccagaggctggggtacaagaatcacttgaacctgggagttggagtttgcagtgagccaagatcactgcactccagcctgggtggcagagggagactctatctcaaaa

SEQ ID NO: 55699 - DNA, 573 bp, Homo sapiens
gtcatttgcatccagtagctattcagcaaatatacctatggcaaaaaggatataagttatgggtataactgaaataatcctgggtttaaagcaaagctctgataaatacagaagatgtttctccaggtgccagaagatatgttgaagtttgagctcagactgaccaaatgctagttatggggtatgtgatagctccaaggtagtaatataaaggctattttaattagaaacttttgagtaaatggccctcaggatagtgatttctgtttgaatgtcactaaccttttttagttacagatccctataataatgcttgagtctaggcagaacaactttgtgtttattctttgcaaagggtagggtagtgctaacaacctgctcttcatttgctttttctcccctttgccgattcagaatgctgctttgtcaatttgtgtgcctgctgtaggaactggtccgttttccaagtgtgacagtgcaggcagagaagggtggatgagctgtaaatgcagcctagaacacatttgattatagagaatgaagcactaatatcccaatataattggagtttaa

SEQ ID NO: 55700 - DNA, 257 bp, Homo sapiens
gagactgagtttcgctttttttgcccatgcaacaaaactcccaacctcagatgatctgcccaccttggcatgaaaataaatcatttacagttatgtgcatgagtttatattttttgagtttagaatatttatacataagaaataattcataatacttataattcaattcaactagtgtcatttaaagataacactggatttggaagtgctcttaagttatttactctgggccaaagattagtttcgtatagattctg

SEQ ID NO: 55701 - DNA, 1306 bp, Homo sapiens
ttcctcttctgcccattgagcagtcaaagaactgaaagtccttataagcctgtgcacctgggcctgggccctacagataaggtagctgctattgatgaatttgacaacgcccattttacactccttggggtccccaacaaacccctgcagtgtttggacatcaccgccacaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgagcggagggtctcagcggctacgcggtgcggtacttgaagcccgacgtgacccagacctggcggtactgcctcaaccagaaccccagcctggaccgctacggacagaagcccctgcctttcgactccctgaacactttccgaagcttcggctccagctacaggctagagtgcaatggcctgatctcagctcactgcaacctccgcctcccgggttcaagcaattctcctgcctcagctttctgagtagctgggattacagtcgtgtcaactacctgaccccctggcattaatctctggaaaggaggctgactcccaggctgccggacggtgccacctcaggtcccctggccagaccgaggacttatggtggcaccagccatctccccaggagttcagcctaactagaaataaacctaatgctcccttagagacacacgcaattgtctctgtctgtgtgtgttgcacagcctgggagagggtcagggccacaggatgacagtatcttacccttgcccgtccccggccaactcctggaggactggtggggggttggagaaaaatgtctggtgacctggtttgagagtcagggtgtaagccgcaaggtccagccagaattgagatccaagagcaagagatgtgctccggccccttgcctgcagccccacacccaagccccctccatttcagatcctgaatttgagccctaagaagaaagggagagggctagaaagctatttttaggtgcctttttgaagctcttgtcatactggtgtgctctggggggcttccctgtgcctggggtccccctgaaggtgtgggagcaggctggggcaaggggagctggccaggcctatggccttgattcctgtgacgcaacagaatgtagagtctaaacttgcatgagatgcatgaagccactcagagaagaaagttccccgctctccaaagcaccaccaataaacatgtcatttaagca

SEQ ID NO: 55702 - DNA, 1433 bp, Homo sapiens
ttcctcttctgcccattgagcagtcaaagaactgaaagtccttataagcctgtgcacctgggcctgggccctacagataaggtagctgctattgctatggcccgcatcattgacctggtgccctgggacgatggctccacacatgtgtatgcctccccggccatcctgcttcccatggagcggcagcgcaaccagctggcgggcgtgaagcagcagctctaccacccagccctgcccaccctgcgccacatggacagggacaccgtcaaggcctgccttcctgatgagcactgccagtccaccacctactgccgcaaagatgaatttgacaacgcccattttacactccttggggtccccaacaaacccctgcagtgtttggacatcaccgccacaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgagcggagggtctcagcggctacgcggtgcggtacttgaagcccgacgtgacccagacctggcggtactgcctcaaccagaaccccagcctggaccgctacggacagaagcccctgcctttcgactccctgaacactttccgaagcttcggctccagctacagtcgtgtcaactacctgaccccctggcattaatctctggaaaggaggctgactcccaggctgccggacggtgccacctcaggtcccctggccagaccgaggacttatggtggcaccagccatctccccaggagttcagcctaactagaaataaacctaatgctcccttagagacacacgcaattgtctctgtctgtgtgtgttgcacagcctgggagagggtcagggccacaggatgacagtatcttacccttgcccgtccccggccaactcctggaggactggtggggggttggagaaaaatgtctggtgacctggtttgagagtcagggtgtaagccgcaaggtccagccagaattgagatccaagagcaagagatgtgctccggccccttgcctgcagccccacacccaagccccctccatttcagatcctgaatttgagccctaagaagaaagggagagggctagaaagctatttttaggtgcctttttgaagctcttgtcatactggtgtgctctggggggcttccctgtgcctggggtccccctgaaggtgtgggagcaggctggggcaaggggagctggccaggcctatggccttgattcctgtgacgcaacagaatgtagagtctaaacttgcatgagatgcatgaagccactcagagaagaaagttccccgctctccaaagcaccaccaataaacatgtcatttaagca

SEQ ID NO: 55703 - DNA, 379 bp, Homo sapiens
aaaaagaaaaaaaagattctctccacctacattcattaccgtttctgggaagagttctgataaattcagtttttgcaaccttgctccatttccagtgatattcttgaatcccttatgattgtggtgacccagcccgcttcctagctgggatgctccttcatctggttctgcctaactcacccctcagcccccactgccttgggtaagtccttagaaagagaactgacaaattaaagtgagacattctttcattcattccatagctatttattgagcttcttagaagagcttcagctacctggctagcattcttagacatcaatgggcaaccaacttgtcattggcagttttacatgtgaagtcagcactccacaagcaa

SEQ ID NO: 55704 - DNA, 887 bp, Homo sapiens
  misc_feature (456)..(456): n is a, c, g, or t
gtaagtatcaggaatctattgtgaggtagataagttttcccctccaaagagtattctaagttggtcaattaaaaagaaacaaaacttctattagcaacctccaccttgtacaggctcagagggaagataaacctgcaaaaagtgtgagtctcagctgtaacctaccaactatgtgagcttgggaaagttacccagcttccctatgcctcaatctgttcatccataaaatgaggataacaccagtatctatctaaggaatatgaatatattatatgcgtatttatatatcaagaatacatatacaatgctcataacataaaaaatcaaacataacatcaaataaaatatatgattctgatattataagcctcttatgtattgtaatatagaaggatggctttgtaataaaaaataaattaagccacaaccaaagttttcatacaggactaagtagtncatagttacctcaaatcctccttagaaacagggtaaggcatgggagtaagaatgtatactacttcctttaaaagtgtaatttaatatgcattctgttaagaagatgtttatatttatacacatatgagtgcacatttttaaaaggcctccaaagccaagaatacagaggtttcttaacagttgaaaataattcataatgattgccatttgttgccattttatttaggcttatgggaacaaagtctaaaaggaaatcaggcaatgtgtcaggccccttgcacaggtaatttcttttaatccttagaagaaccctatcatatcccacaaaggaagttactgagctaaaaagtgaggaaaccaggttggcctcacttccaaacccaaattcagctgcaccatgatccatgggagtgagtcttcctttgttccag

SEQ ID NO: 55705 - DNA, 368 bp, Homo sapiens
tgattgaaactttaaacccttcccttaagttcccctaaaaacctccctgtgcctagtaaggttttgcatgtgtgaggagggtgaaggtatttggaccttggagaaactttgcaatttgaaatctgcctatgcagttgtacaccagaaatgaacatggtcaatgccatattgtgctctttgtctttttcttctaccaagattcctcacccctaggagacgttggttaatataggcatttcggtttggttaatctgatcatgagtgcccgtgagcatggcatgaggcatgattgaagcagttataaaaatttggctcagagttaagccctataatttgttttaaagaattacctcttcagtgacattaaa

SEQ ID NO: 55706 - DNA, 416 bp, Homo sapiens
ctgccaagccatgttttggccacttggctcacctcatcctgtccctgattttccatttccaatgtgagtctcaagcttcagttgccagctagcagcagccattcttaggagagcctattaggattgccttgcccatgaaggctcattttgtacttattttatatttttgctctttagcattttctgtaaatcttttgctacagttaaactgggacaacagaaacattttcatcctatgataatgaagcaataaagagaggagacatgtactgtcttcttggttttataagtaacttaagtgtactcagaatatcattctttagtattctcaaatgtttttgatgtgctactaatttatatttagtttctttctgttcttcagaaggtagctatgacctatggctagacaataaaaa

SEQ ID NO: 55707 - DNA, 511 bp, Homo sapiens
tctgtgacattttgtgacttcggtgaaggcatgcaggctaaggaacctgaggagaattaattcatcatgtacatatgctaaaacaacagcagcacaaatgttgaaacaacttatttatttattcctaaaaatgaaagtgatgcacaaattagagcaaagttataaaaaaaaatttctaagggagaggcatgatgatgttgtagaaagagcactagattgaaaccaagaacttagacttttagacaaatacttaagattttagtttccagctctacctattagctgacttcctacaagcaaaattccatatactccttcaaaatgtcaagttcagctaaccaactgaagtagctctttattctctaaatattacaggccctttaaaaaagaatatagttttggccaggcgtggtgtgtcacgccaatactttgggaggctaaggtgggcggatcaccttaggtcgggagttagagatcagcctggccaacatggagaaaccccgtctctact

SEQ ID NO: 55708 - DNA, 513 bp, Homo sapiens
ctagtctcatgaccctcgtgcactgggatatttgacctgcgggacctcggagatccccctgcttcccccctccccccttccagctctctcgtgttctctttgcctcctccaggtgttggttctctcttaagaatccccaggatgaatatgactaagcatttcctctcgagtaaaacgttctggcacctttcttctcccgggggtcatgtttcttaggacattgacctgatgcttgattctttccttgttccagcttaaatttaagtgactaggtaaaatagtagcatgtgaatcccgttgatctctggtggcagatagagtggttttttggctgtcttaattcttttaaaactgtcagtccctttactgaagcacctgctaaagatcagcctggtgtaatttctatgaagaggagcctctctgtaggcaagtatgacaactttaccaatggaaattgttaacattaggatgaggcatgctgccacatggatcaggtgacatttatgtatgaga

SEQ ID NO: 55709 - DNA, 973 bp, Homo sapiens
taaatagggaaatgtgtttggtgcagagccaatgtcattccaaaaagctctctcttttcctggtcagtcatgtgctgggacagagaagggatctggattaggcaacatcatagagttgctctgagctgctctttggtgataacccttccaaatcctaaactttttggaattcacaagctcaaaggaggaaacctactctctgatctaccacatgttctgcatttttctatcatggtctatggaaacttctcttagaaatccagtggcaagaagttctatgattaaagtgttctgagctcaggccaggcagtcatgaactacttctgagttatttactactgatttgtggggcagcctcagctatcggtttcttcacacctgcttatgagagtatccatatttatggtcgcaggccagtaatgctccccacgagatcagtttctgaactaacctggaattttttatgggtttttattatgccaactattaaatcaacattacagttcttccctctgtatttctcctgtaaaacattaggcctgcaaaaaaaaaaaatctttttaaaaataattgccataaagtatttgctctgggcctactgtatgcttcttttctttttctctcttttcaactaagtcaccgtcaatttattaagatggccataactattcaaaacctatgctaagttcctcaaggcagggtcgcatagtgatgaaggttgggatggggctacggaagaaaccagaacaactctagtttatttaaaacctgtatttactgcccacttccccttagacttgaccatatgacccctcgctcccattctaagcataggggcaggctttatttttacaatggtaatagatatcacttgaggttttatcaaagagttgcggcgggtggtgaaagttcacaaccagattcaggttttgtttgtgccagattctaattttacatgtttcttttgccaaag

SEQ ID NO: 55710 - DNA, 977 bp, Homo sapiens
ggggcctcttcatggcctctgcattcagctgctgtcaccctccgcacaggccatggccaaaatttaattttcatagtggactctagtttttgagccttacttgctattattgaaataattttcttgtttctttttaaagatcttcggattatgcttcactgaccactgtaataagtttaaagttgagaaaatatggcttgttaatgaatgataggtcaattttagtatgttggtcattttaatattttgccaccagttggtttggatttgatgccaggaggagacagcctcatttctaaggactagtcttgcctttgtgggataagggtggtgtgttctgtgtccttctacatgtccgagcgatctctgtgcagctcaaatgtggtcactgtcttattgcgctgatttcctctccttccatctcacaattgaggcaaaatattgttactgttgaagtgttgtccaataggacttccagcagagacaggatgtctgcactgtctaatttagttgcctttagccacatgtggtgttctgtacctgaaatgtggctggtctgattggatagcttaatttataattttatttaattttaattaacttaaatttaaacagctctgtgtggatagtggctcctgtatgagacagtgcaggtctgttgagaagcagctttactggtgggagtggagggcttggagagggcacgtgggtttcctgctggtatcttttgaccttatttaatctgcccaacatttgcaagtaagttgtgtgtgtgtgtatatataaatgtgtgtttctgtcttcttgtttcctttgactgcatttatttgaaagacactaggtggcagaattactgtatttgattggtttcaagataagagttgaaataattcatctcgtgtttttatataagtaaggtgtgtttagcatgtaaaattggtaatatgtattcacgtactgcttaaacaaaggctatg

SEQ ID NO: 55711 - DNA, 271 bp, Homo sapiens
gctggagtttggggtggcgtggcagtggtacagcagtgggacacagtggagggaaggggagagggaaacggaggtaaatgagggaggtggctggggcatgggattcagggaggacggggtcaggagcccagagacctgggtctccatcctggcctggctacacactcactgtgtgatctcgggcaaatcactcaccttccttgagcctcagtttccccacctgtagaccaaagattggactgatggtctcggcagccccttccagcccaga

SEQ ID NO: 55712 - DNA, 2897 bp, Homo sapiens
gcagacacacacggacacacagagacaccagacacacatatacacatgcacacacagatgcacacacatgcacacacatgcacagagacacacagatgcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacata

SEQ ID NO: 55713 - DNA, 8957 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 55714 - DNA, 8703 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactgatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 55715 - DNA, 8859 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 55716 - DNA, 6683 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcata

SEQ ID NO: 55717 - DNA, 5005 bp, Homo sapiens
tgtattgtccatggcatatatattacatgtaggttgaagctcgtgtctacgcgttcgaattctatgaatggtgaatatgtaaattattgatgaatgtatgctatgacgatctccaactaggagtagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 55718 - DNA, 4870 bp, Homo sapiens
gggtcgtgtgtcctgcacttcagcctgggcaacagagcaagactgcgtctttctccctctctccatatatacacacacacacacatacacacacacacatatacattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 55719 - DNA, 8128 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgtcgacgccgcgaatttagtagtagtag

SEQ ID NO: 55720 - DNA, 6211 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgata

SEQ ID NO: 55721 - DNA, 947 bp, Homo sapiens
cagagccccaatatctggagtaatgctgctcttgtagaatagttgttacatttacatccagaaacatagggcgttatggcacagggcgtgtcctgagcattcagatgatgcagagccacggctgttgtgtacatgtgtgttggaaccactgagaaagatgtgttgcttttgttccctgtagtagattttccaacaccaaagactgagctggtccagaagttccacgtgcagtacttgggcatgttacctgtagacaaaccagtcggtatgtgaaatgtttattgtctttccactttgcaagtgtgcgggagctcacaggaggcgttcgccctccgaggagggtgaggtctgctgtttactctcacgccttgtcttgaatcaaactgtcacactgtcaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcata

SEQ ID NO: 55722 - DNA, 1650 bp, Homo sapiens
tggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacaggtacccctggggaaggcgtagcctcagctggcacttttttttttttatcttttcaactattggagtaaatctctagactgaccaaaaatgtccattatgcagagaggaacgtgagcctcttgcggtaaaattgggcaatttatttgcaaaatattactgcattcctcaaccatattttaggtcagtttcatttt

SEQ ID NO: 55723 - DNA, 139 bp, Homo sapiens
tggccacacacacgattaggctttccagcctgcatgaagaagacagcgtgttttctcgttgtgtcccaggggaaagacatgtacctgatcctggagaatgacatgctcagcctggtggaccccatggaccgcagcgtgc

SEQ ID NO: 55724 - DNA, 564 bp, Homo sapiens
gttgatttggcagctttttgttttatatggttttagatggaaatgtgattcagtgtgctgtttagtttgggtaagaatcactggacgaagaaagataccgtgaatcccttttttctggtgctctgggggtttacttggccaaatgggttttgggccaccaggtgtcctgtatttgggctagatgtaagaagtatggacggcactgtccctccccacagtgaactcacagccacgtagcataatggagaatgggacccacatcacaccccatgacagcagtgtagttcagagcaagaatgacctccagaacagggtagccatgcagtgatggcctcttcagacatttgggcaaggttccgcctttcgagaaaaacacaggtcctttctgaattcggcctggctatactttctgaatgccagttcctatgtgctgccactcttaagcttgatcctgggatctcctgattggatgccgcataatgtctcttgcagaatgaagaggaagtcttagtggaatgtcgtgtgcgattcctgtccttcatgggtgttgggaaggacgtccac

SEQ ID NO: 55725 - DNA, 1774 bp, Homo sapiens
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaattcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaat

SEQ ID NO: 55726 - DNA, 702 bp, Homo sapiens
aaattgagtagtcatttcttaggataagcactgtctcaataacatcaggaatttggcagaaacttgatctgtaggagccagtgtatttgaccaaaggacattgagtcggggatgctgaccctagcccaaactctgtagtacctatagccgtgttgtacattatggtagccacatgtgactatttaattaaaattcagttcctcagttgcacttgacacatttcaagtacttcatagccacttgtggctagtggctaccatcttggatagcacacaggtagaatattgccatcttcacagatatttctattgggccgtgctgttctatagaattatttacaaagtgagtcaggtctaccacagtggagaaaagataatatttaggcagtacgtcatgtacctttaacacgccccacccaaggatcattacctggccatgagctgaccttgaaagccagaggcattcccaatggaaactgagaattttgatgaatgtataattgaacttaactgtcactatatttatctatttagcccatcatgttatctaagaacagataatgtatgcctaaccaaagtaaaatacctatgaagacatgattagcgtcactgtgagtctcagttatctttaaataataatcatattcaagttatagaagttacttatgttaaggtaggatttttgaattttaagaaatacaaa

SEQ ID NO: 55727 - DNA, 347 bp, Homo sapiens
gtcaaatccattaggttgacattcaagtcactggatttgtattagaaatgtattgttcattggggctggtggctcacacttgtaatcgtagcattttgggaggccaaatcaggaggactgtttgagcccaggtgtttgagaccagcctgggcaacacagtgagaccctgcctctacaaaaaaaataaaaataactagccaggcgtggtgacacatgcctgtagtcccagctacttggctgaggtgggaggattgcttgggcccagaaggtcaaggctgcattgagccttgattgtgccactgcaccccagcctgggtgacagagtgagactctgtcttaaaaaaaaa

SEQ ID NO: 55728 - DNA, 414 bp, Homo sapiens
catgttcttcttccttcagtctttcattctggttatgctttggtcccatttgttacatgtaggtagaattctgtcctaaaccttatctttgcccaagcattttaaaacatgagattttagaaaatccaggtgaggctgggtatggtagctcacacctatactcccagcacttagggaggccaaggtgggcagatcacttgaggccaggagtttgagaccagcctggcccgcatggcaaaacctcatctctacaaaaaaataaaaaattagccaggcatggtgggacacgcctgctgtactcccagctatgaggtaggaggatcacttgagctcaggagggcaaggcttcagtgagctgagatcatgccactgcactccagccggggcaacaaagggagaccctgtgtctcaaaa

SEQ ID NO: 55729 - DNA, 400 bp, Homo sapiens
tctgcactgaatctagggtaagacttcggtaggataggagaattaagttggtcttgaaattgaggcatgagaggggtccggcttgttggttgggagactgcctaaacaagttatagccacgccattctagacacttccatcctagaagggagggcccaggaagtctgtatataaccaactctagggcagaggctgccagctggtggcccgtgagccagacttgggccccagagatagatttgtttggtttgtggtgttgtaaataattttgaattagttgccaacatttgaaaatcaggacttgccttttctcttgaaaaatcaaaagttcaggcatcattggacccaaattcctgcccgataaaataagctggatttcagtagtcgtagcttctttaaa

SEQ ID NO: 55730 - DNA, 301 bp, Homo sapiens
tctagaccctaagagtttacatttgattcatttggcaatgacttactactgaaaggcactcaagtgccatgattgctgctgtgcttgtgtgagttttctcttttgtccctctcacccttggagcgttatgtgagtggacttggatgaggtctgtgggctagagatagtgactagattctgagggaagaactcgaatgtagtatcttgcctgagatagtctgaatctcagttgaatctaggaagagccctaggaataaattggagttgaaggtcttgagggagcaggtggtggctaaagggt

SEQ ID NO: 55731 - DNA, 1972 bp, Homo sapiens
ggccaggctggtattgaattcctgacctcctgatccacccgccttggcctcccaaagtgccaggactgcaggcatgagccaccgtgcctggcagattggaacgttttaacatgagaggagcacttccccaatttatcccttcatcctaagattgtgaaaaagtcccaaagagtgggaatggagacagactactgtattttaggtttaaaaagaaaaatccagaaagtgtcctgtgaagagctaggacccccagaggttctaatgcacatgacttgaaggtgatttgatgtgggagtgagggcagagggtggggtggctgtgcctgtggactcctgtggccctggggttgttagggcaggcagtccacagtcccagatccctgcccattttggctctttcttttacccactcatattttccttgaaaatgtttttgccagaacattaataactgtcagccttttagaatcaggagacttacgtacaaatctggattttcagcttttcttagaaaaactgtagtttctgacaacagtaggccccattcctcacagccagtcaccaccctcctcccattcctcacagccagtcaccaccctcctggaccatactcggccctgggccattcctcacagccagtcaccaccctcctcccattcctcacagccagtcaccaccctcctggaccacactcggccctgggccattcctcacagccagtcaccaccctcctggaccatactcagggccctggaggcctggcaacccaggccccaactcaaacttgtacattcagtctattcagtcggactcgcactggggcaagggtgacagacacgagaatggaaaattgagaaggctgcccgcaccagctgggtgggtgcagggggccccagctcatcatcagcactgtcgtggggtgggagtcgggggtaaaggttccgtctgaccctgaggggttgaggatattcaggtggtccagcctcccgcagaagacttccctgtcacccttggcagacaggtttcttctcacacggccctggcccatccactcgccatgaagccctctgtgctcagggtgatggagccccctccattctggcactgcactgtgggcatgagcttgccttaaaaagaaaggagaggccaggcacggtggctcgtgccctataatcccagcacactgggaggccaaggtgggaggattgctggagtccaggagtttctacatgggagactctgtctctacaaattttttttttttttttggagacagagtctcactttgtcacccaggctggagttcagtggcgtgatctcggctcacagcaacctccgcctccgtgggttcaagcgattctcctgcctcagcctcgtggagtagctgggattacaggcgcgcgccaccgggcctggctaatggtattcttagttgagacgggtttcgccatgttgatcgggccggtcaggctggaatttctgacctcaggtgatccaaccacctcagcctcccaaaatgctgggattataggcgtgagccactgcacctggcaaaaaattttttttaaaaaaggagaaagcagtttaaccacaaacagtgaaacagagctggcagacgcctgaaactccatggaaccatgcagctgtaccctagggctcctcccaggaaaagagagatgtcaacgtggcccaaggtgtcctgaagcactgggattggattaactcgagcgatggccttcccagccctccgtgctgcagagcctctgctcgctaggctgccttcatctcactctgtgtgctgtgcctgtgcacctgtcttgtcaataactgcatatattgtgttgcgttgcctgtcttgctggataactgcatatattgtgttcagttgtgtatttgttttgctttcagtctatatacagttgggtttccaacctctgattctggaataaacagttgcagcgtgtctgagtgaa

SEQ ID NO: 55732 - DNA, 1586 bp, Homo sapiens
ggtaccggccccgaaggatttaatcatattttccttgaaaatgtttttgccagaacattaataactgtcagccttttagaatcaggagacttacgtacaaatctggattttcagcttttcttagaaaaactgtagtttctgacaacagtaggccccattcctcacagccagtcaccaccctcctcccattcctcacagccagtcaccaccctcctggaccatactcggccctgggccattcctcacagccagtcaccaccctcctcccattcctcacagccagtcaccaccctcctggaccacactcggccctgggccattcctcacagccagtcaccaccctcctggaccatactcagggccctggaggcctggcaacccaggccccaactcaaacttgtacattcagtctattcagtcggactcgcactggggcaagggtgacagacacgagaatggaaaattgagaaggctgcccgcaccagctgggtgggtgcagggggccccagctcatcatcagcactgtcgtggggtgggagtcgggggtaaaggttccgtctgaccctgaggggttgaggatattcaggtggtccagcctcccgcagaagacttccctgtcacccttggcagacaggtttcttctcacacggccctggcccatccactcgccatgaagccctctgtgctcagggtgatggagccccctccattctggcactgcactgtgggcatgagcttgccttaaaaagaaaggagaggccaggcacggtggctcgtgccctataatcccagcacactgggaggccaaggtgggaggattgctggagtccaggagtttctacatgggagactctgtctctacaaattttttttttttttttggagacagagtctcactttgtcacccaggctggagttcagtggcgtgatctcggctcacagcaacctccgcctccgtgggttcaagcgattctcctgcctcagcctcgtggagtagctgggattacaggcgcgcgccaccgggcctggctaatggtattcttagttgagacgggtttcgccatgttgatcgggccggtcaggctggaatttctgacctcaggtgatccaaccacctcagcctcccaaaatgctgggattataggcgtgagccactgcacctggcaaaaaattttttttaaaaaaggagaaagcagtttaaccacaaacagtgaaacagagctggcagacgcctgaaactccatggaaccatgcagctgtaccctagggctcctcccaggaaaagagagatgtcaacgtggcccaaggtgtcctgaagcactgggattggattaactcgagcgatggccttcccagccctccgtgctgcagagcctctgctcgctaggctgccttcatctcactctgtgtgctgtgcctgtgcacctgtcttgtcaataactgcatatattgtgttgcgttgcctgtcttgctggataactgcatatattgtgttcagttgtgtatttgttttgctttcagtctatatacagttgggtttccaacctctgattctggaataaacagttgcagcgtgtctgagtgaa

SEQ ID NO: 55733 - DNA, 668 bp, Homo sapiens
tcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaaatcttaagtattactttcttcctccaaacaagtttttaaaaaataggataaattttttttctataaaatataaaacatggaaaatagggaatgctgtttttgaggtaatattaataatacacagaattttcattagtgtcgaaggatctaaaaagacaaagtatatcatgggaataaaaaaagatagaaaaggaaacagtttaggaatttgccttaacaaatgaaaatgcctttttaaaatggcatcagtcaagcaagttgctgtgcattattatatgtccaaataaaatgctaattcataaaa

SEQ ID NO: 55734 - DNA, 273 bp, Homo sapiens
gttttcctgatgtcttcgttggaatgtaagctttgtgaaagccaggggccctatgtgtcatctttaccactatgtcttagatcttagagcagcccatcataagttctaataagtaattgtggaattggatgagaaaatgaatatgagtcagttttacaatgctgcatgcttcccagattattttaacagtctaggggatgtggaaagattttgttttaaaaacgtttaaaagtccacgttttgtttgatattgttcagaggaagtgaaaatgt

SEQ ID NO: 55735 - DNA, 395 bp, Homo sapiens
ctcacctattcccttagctctaaatgtcacctatatgttgatgattcctgagtttatgtcttctgagatccacgtggatgtctagtagacatctcacacctaacacgtctacaaccaaactcccagttccatctcccctgttcccatcccaaccccacttatcctctttgacctgcaccttctgcatctcaacaaatggcaccacaaccaatgctcaagccagcacctaggagtcatccttgattcctctgagccccgcttccttccctggctacacacagaatcattatcttgcgccgttgactctgtgccctgaaatatcccaaatctgttcacttctctgaatgtccacttttagtaccttcagctctcgcctggacacctgcagtggtttt

SEQ ID NO: 55736 - DNA, 120 bp, Homo sapiens
ctaacaccaaatgtggtgttccatcaccacatttatagaaaaatatatattacaattattggtttctatgtctgtttccagttctcctcaacttgctcctcaaggtacagtatccatgtc

SEQ ID NO: 55737 - DNA, 262 bp, Homo sapiens
cctttttattttgtaatcttatctgttattataaagcagttttaaacagagaactaatttcttccctaatttcatgttaataagatgatccattgaccccacattctagtaaatttcattaaaatatctctactgaattggactaaaaattcatttatgaaaagtttatgagagtcttccatgaggctttaactcaaagttagtaaatatgaagttatcactcctcactcaggtgaaaatcaatgtgtatgtatagctgtgg

SEQ ID NO: 55738 - DNA, 168 bp, Homo sapiens
tgggagggcagccgtgtgagatgcggggttgcgagcgtggaaacactcgcagtcgccagtgctgaggcatgtttcagccggggcggaatcacatgcattaattattgtacagagatgtctttagtagaaaatgattttgaaattcagtttaatttcattgtaatgtgc

SEQ ID NO: 55739 - DNA, 105 bp, Homo sapiens
tagctagggaacttttaaaaatgcagatctgattattaactcccctgaataaaaagtggtttcccatttctctcagggtaaagacaaaagtcctgaacataaccc

SEQ ID NO: 55740 - DNA, 662 bp, Homo sapiens
atcagtgaggggcagggaaagaggatggagttttagtccttagtgtccaagttgtgtatatttaggggtcggtgacaaggagagaagggagtaaagtgtttgactcttttccctccattattcctcaaggtacctaagggctcatgacagtgttttgtttaatgtgctattcgttctaatatactaagaacccacaaaaaggcaatataaatattaagccagagaaatatcttgaacttcatttattttaaatgtgtactgttatggcaaacaaaagcagctccattggccgggaatctaagacaacgttgtaatatgggcatgtgtaaaatcttgaattgttttctaatttgtgttcggcttcaaatatttcattacatactttgatcctgatcctgacataaatgaaattaagtgtcttatggttgaataaactagatgaaacaaagaagccgtgatttttctcctaggcaggtataaatatacaggtgaccattgaaaaacacaagggttaggggagctgacccctgggcagttgaaaaatctacctgtaagttttgactcccccaaaacttaacttacttaactaccaataacctgttgaccagaagccttaccaataacataaacaattaacatatatatgtgtatatatatatatg

SEQ ID NO: 55741 - DNA, 247 bp, Homo sapiens
tctgcaggatggagaggtttgaaaattgctaagtgctttgtacaacttataaaaatccacgttgcccagtttccaagcagtctcatgttcagtagacaaaaggcaattttcaaactgaaattctttacttgcatttctatttctattttccttccttcctttcttccttccttccttccttctttcctttcctttcctttcctttcctttcctttcctttcctttcctttcctttcctttcctttcc

SEQ ID NO: 55742 - DNA, 479 bp, Homo sapiens
tgattaagtcacatcaggtaggccctaggcctgggtctgacccacgcagttaccccctcaggattctgagaaggtgagaaaggaggacgtgaaggaggctctgtggagccagactgcctacttccgccacccacaccatctgtgactcagcaagttactcaacctttctagacctcagtttccttatgggcaaaatgagactaatgtaacatctctctcataggattgttatgatgattaaagcaggtaatgcccagggcttgacatctcatgttccatattttgcatgggagaaaattgagttcagagaaaagaacttgtcaaaagtaacacatgcagtcactatttgaatccaggtctttcttgagccaagtccacgttcactgtactgggaagctcagtatatataggagaaggtactggaacattgttggaaacctacagctgagtatagaggtgagaggctttatcctggaggc

SEQ ID NO: 55743 - DNA, 268 bp, Homo sapiens
tcaagccttaatgaaatcttacatccacaggtagggaaacccactagactagcatattcgagagtttaaattttgctttatagctctcttaataaagatatgtatttctcagatttgccatgcactttcagtggatgtaagatttcattaaggcttgagtactagcatgaggtcttagtggcacgcactcacacccaattctgttccccctatatgggcaggggacattgctgacagctttgcattgtccctctgttcttatgtagac

SEQ ID NO: 55744 - DNA, 405 bp, Homo sapiens
ccgaggcaggcagatcacctcaggtcaggagttcaacaccagcctggccaacatggtgaaaccctgtctctgctaaaaatacaaaaattagtcaagtgcgatggaacacacctgtgatcccagctacttgggagactgaggcaggagaatcacttaaacccaggaggcagaggttacagtgagctgagactgcaccactgcactccagcctgggcaactaagactccgcctcaattaaaataaaataaaataaaataaaataaaataaaataaaataaaaagcttgcttcgtggttaaatctaagtcaaggtcataacttcagagatgaaaagccttcttggctacttttagaacacttgattattttcagcatattaaggtactaattttgttggctttaaaat

SEQ ID NO: 55745 - DNA, 1035 bp, Homo sapiens
ccatccttgtatcacaggcaatatgtctttctggaaatctaatgaaccataccaaatctgcatgatgaagattgtgtaatgatggtgatatcatgccagttatcctcaaagtgggaatatgaccattagctggcattttttaagatttccttagaagggtttaatcaacactgccattacacatggatttaacaaaagacttttgaaaattttttacatactgattttagaataatcctcaaggttctatagtcatttttagtggaagacttaaaaagaaaggaacaatttttactgtgacttcaatttcatagtattttaaacatattttgtaattcagaatgtttagcaatccctatgtcctgtttcacatgcatggtaactgatggtgggttgcctacaggctggaagatttggagagagccattttgtttcataaatcagtttttattgcacagaagcagctggttgtatttcaagttgggaaaaagaaaagtaaatgccagaaaaggcaaaggataaacttagtaagccatttattttgttttagaattgtttttgcaaagcaaatttttttaaaaaaaggtcaacaaagtgaatcagcactagcattttcttgatggttgactcaatgtataattaacaaatatacatagcagagtcaattaatcatagtgccattatgtcacttatttgtcattgcaaagtattcagtcatgttgtctagatttactttagatggtgcaaaatttccagatagtaacctatgtaaaaggatttgtaatttccttgtaattcctgcctattagtccatattctgatttccttatgttcatcactgatatgttcctgatcagggtcattgctagtagttgagcatttactggttgaacattgtttaatggttagatgttatgtgtgtctgcatttaaaaaaattgtgtacatgttatttcactattggtattacaatattcataaccacatgataaacagaaatgtacccaataatttcctataaaatttttcaaagtcc

SEQ ID NO: 55746 - DNA, 355 bp, Homo sapiens
caccacagcaccatcatgtgttagtagttgtttttcccagaaagagcagctctgtgccatatagctaggtagctacatgccaggttggtcaccttgttgcatgtgtttcacgtttacccaaagaagtaccctattgcttatgagactatgctttgaatagtcccaagatattttcccacccttcctctttcaagttatctattcctgcattaaaaaccactgcagggctaggcatggtgacttatgcctgtacccaacactttgagaggctgaggtgggaggatcacttgagcccaggagtctgagaccagcctaggcaacagtgacaccccatctctacttacagaaaaaaaaa

SEQ ID NO: 55747 - DNA, 450 bp, Homo sapiens
aagaagggcaagaaagaggctcaaattacctagctggtctcagaggggacctcaaaagtgcagctcctctccacccccatggcaagatgacaccttaaggcagctgtttctgttggccctgggcccacctctctgtgcccctgggctctgccgggtttggtttcctgtggggtggagagatggcaggggatcctctggcccttggggagtgtgggatactggaaggaggtagggaagagacaatagttctgtctttctcccgctccctgtcccgggcctgggcaagcagcagcttagctgggcagcacctgagcaggggcaaggctctccacacggtctgacctgccgtgtggagggagaaggaggacagcagagaagactgctgtcagaggggagttcagtagtacctaatgagctggattcttacttacagggttataaagtgtgaag

SEQ ID NO: 55748 - DNA, 321 bp, Homo sapiens
gaagcacattgcgggccgttggatgccaagccacgatggagctgagatgctttatcattaatatagttcagaaaaaactaggtaatctttcttacttcctttttaaaaatctgtgcccatcaagacaaattaaatgcttaaaaagttacaagtaatatttcacacatgtatatacataaacagagtgagaaaggaagagatatttacagaaaaaggtatacttgaaaaataaagctttaaatagtctttctgaatttaatgaatacaagcatcgtgttagaaaaaaaaaaaagttgcatcgactgaccagatgacatacaa

SEQ ID NO: 55749 - DNA, 343 bp, Homo sapiens
cctcagggcaaacattgcctgttagagaagtcctatgtgaagtagcaatggcccagctctgatacccccactatgccagacattggctgggagcatgtccgggagagtacgaactccataagaatcaaaaagtgttacagtcagtggctctcagtgagttaatagtctttgcagcaggctattttttggagggagaactgagcagcctgctcacaggcctgccacaaagtcaaacaaagggtgtccatcatctagtccttgctaacatcccataacccaccttttacaactcaatggcatagaccctaggtctggctatgcatcaactggtgtgtgctctatc

SEQ ID NO: 55750 - DNA, 483 bp, Homo sapiens
gacttcatcccagcaactcggaatgcttggcccgggcggcactcggcctctccgcagcagttctcgaactggcctccttgaacgtccgcttcgccttcgcttctgcaacctggatctgggggactgcgggccaggcgcggcgtgacccctggtgaacggtggccgccttttcccacccctgccctcccatcctcccttcccgtttcaccccgccccctctctcctccccaagcctgacagcccgcgagctgccaagcagggcgcagccatgggaagaggaggagggctagggagcggcggcggcggcggcagcggcagcagcggctgctacagtggcggtggcggcggcggctgctgctgagcccgggcggcggcggggaccccgggctggggccacgccggaggccccggcaccattggccccagcgcagacggaacccgcgctctctgatcagaggcgaagctcggaggtctacaggtatg

SEQ ID NO: 55751 - DNA, 379 bp, Homo sapiens
ggattctaatcaggagaccagtgctcatgtgcacagctttgagtgtgaagatctaaaaattttagttggtaggatgattacagattattttcatcttcctctttacagattattttcatcttcctctttaaacttttgtatatttttcacattttctagaaggaagttttagaaacagaagtgggaaaaaaaacaacttaaaaaaagccccgggccaggcgcacggcgtcacacctgtaatcccagcactttgggaggctgaggtgggcggatcacgaggtcaggaaatcgagactatcctggccaacacagtgaaaccccgtctctactaaaatgcaaaaaattagccgggcatggtggcgggcgcctgtagtcccag

SEQ ID NO: 55752 - DNA, 690 bp, Homo sapiens
catcttttcacagaagagactccttaaccactggttctgttgggtggagtgactcaggtcctgtgttttcaaggctgccattggctatgagccagaggtgggtgctcatttaggctgtggccgtggtggccacaggccatggcaccatttcttgccatgatgcacatcccaagtgaagtggggtaggactctttgaggttccctttctgtgtgaacagttctgagaacagggcttcctggatgtcccctcccaccctgacacgggccacaacagttagggactgcacaagcagagtggaagccaaaccacaagcggagcggaagccaaatccagaatgggccaagtgacatgtcaccaagttaaggtgaaggagggagagcccaggtgtggctggggcaggcctgagagtgggggtgagatgacaatagagaaagcagagctttctccccagcgttgcaggatttcggtatgctgtcccctctggcttatggtgttgccccttctttcttcttcaaatacccctgacaaagggatcaatcttagagagtttattaaaaaaaaatcttcttctaaatagtatttgggcaggagatgatgtatacaggagcgagggccagggaggctgtagccagtcctagaataaacactctgtgcatctctatttcttgtgatccttccatcactcagac

SEQ ID NO: 55753 - DNA, 494 bp, Homo sapiens
cccgggctgttggaattcggcactagcctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55754 - DNA, 3540 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55755 - DNA, 3572 bp, Homo sapiens
  misc_feature (3553)..(3553): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataataaaaaaaaaacantcattggccgccgtttaca

SEQ ID NO: 55756 - DNA, 3516 bp, Homo sapiens
  misc_feature (3497)..(3497): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataataaaaaaaaaacantcattggccgccgtttaca

SEQ ID NO: 55757 - DNA, 3810 bp, Homo sapiens
  misc_feature (3592)..(3593): n is a, c, g, or t
  misc_feature (3596)..(3596): n is a, c, g, or t
  misc_feature (3604)..(3604): n is a, c, g, or t
  misc_feature (3609)..(3610): n is a, c, g, or t
  misc_feature (3616)..(3616): n is a, c, g, or t
  misc_feature (3627)..(3627): n is a, c, g, or t
  misc_feature (3675)..(3675): n is a, c, g, or t
  misc_feature (3727)..(3727): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataataaaaaaaaaaaaaaaaaaaaaaaaaaaaaaaaaaaaaaaaaaaaaaaaaaannaanaaaaaaanaaaannaaaaanaaaaaaaaaanaaaaaaaaaaaaaaaaaaaaacctcggggggggcccgggacccaattngccccttaggggagccgttttacaatcacatggccggcctttatcaaccgcnggaactggagaaacctcttgggttccccaatttatatgcgtttggagcataatccccttttgcacggttgcctgaaaagcgaa

SEQ ID NO: 55758 - DNA, 3599 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataataaaaaaaactcatacatctcgaacatcctaattctcttctactaatcaaaaaaaaaaaa

SEQ ID NO: 55759 - DNA, 3471 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattcagtgtgacaacagtattaaccttagccctaaa

SEQ ID NO: 55760 - DNA, 3210 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaa

SEQ ID NO: 55761 - DNA, 3487 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaaggggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55762 - DNA, 3485 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaattaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55763 - DNA, 2999 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagatgaccttttttataatgcccccagttcatttcagagggcctt

SEQ ID NO: 55764 - DNA, 3486 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55765 - DNA, 2636 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaaaaaagaaatatcattgtcattaaattctgcataaacccattgtcattagctccaaaaaaaaactttagggggggcccagggcccaattaggcctatagtgggtcttttaacaattaattggccgcagtttacaacggtttgacttggaaaaccttgcgtttcccaacttaatctgcttgagaacatcccctttcccggttggtttataaccaagagccctcctgttggcccttccaacagtggccacctgaatggaaatggaaattgagccttaatttttgt

SEQ ID NO: 55766 - DNA, 2580 bp, Homo sapiens
  misc_feature (2406)..(2407): n is a, c, g, or t
  misc_feature (2410)..(2410): n is a, c, g, or t
  misc_feature (2418)..(2418): n is a, c, g, or t
  misc_feature (2423)..(2424): n is a, c, g, or t
  misc_feature (2443)..(2443): n is a, c, g, or t
  misc_feature (2481)..(2481): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaaaaaaaaaaaaaaaaaaaaaaaaaaaaaaaaaaaaaaaaaaaaaaaaaaaaannaanaaaaaaanaaaannaaaaaatttatatattaantaaataatataaatatattttatttttaaaatttattnttattgatcaaaaatttttatataatcaaggggggggccttgtcacaagggtttacctagcagaaaccttctgcttaactcgcatatttgtcctgttcg

SEQ ID NO: 55767 - DNA, 3583 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55768 - DNA, 3385 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctggggtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55769 - DNA, 1971 bp, Homo sapiens
attttgctcttaccatcaacttccctttggggccccgctccccgacccaccgccacatacccaattcttttacatatgaaattacacagatagaaggaaatatcagcttagggtgctagtttcactatttggtataaaagtgttgaaactggcctgtatgtaagcttcatagaaatctgaccgtttacatggagggaaacaagggaagaggacggttgcctcccccactcaaaggttggaattgtagtacagatactcgtggaaatcatcaatggtcgtatttgggtaaagtctgggattcccaaagctgaatgtttttggtaaaagagaagtgaggaactatgaacgatctgagtatgcagataagttggggaaggagaaatggcagcaacagagaaaaaaaaaaaaaaaaaactcgtgccgaattcggcacgaggcatctcagagtccagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcctgtgcagggagaggaagcacccggtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagaccttttttataaggacgccagttccattcaagagggcactgcctgcattcccttcccccctcaaaggccctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55770 - DNA, 2325 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatgcaagggtgctgtggttttgtcccttgccttcctgccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55771 - DNA, 2013 bp, Homo sapiens
  misc_feature (1962)..(1962): n is a, c, g, or t
  misc_feature (1973)..(1973): n is a, c, g, or t
  misc_feature (2010)..(2010): n is a, c, g, or t
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctccctggagccctgggtggcctacagacaacatcgtgggcacaaatgtggcgtgttcttgctgaatgggcctgaatggcgcttcaaccgattgcggctgaatccagaagttgctgtcgccaacgctgtgcagaggttccttccgatggtggatgcagtggnccaggacttcntccaagcccttgagaaagaggtgctgcagaacgcccnggg

SEQ ID NO: 55772 - DNA, 1473 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacgaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcagacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggtgagctcagacttggtgcttcagaactaccacatcccagctggggaaatcaaacatgttatgtgcttccaaaatacagtggttggagaggcataggataaacattcccattccagaaaggagaaacaggaaagaagaaaggagtaacaagtttcaagcaacttccaaaattgaatgtgacaaacagtattaaaccttaagcctcaagaataat

SEQ ID NO: 55773 - DNA, 1261 bp, Homo sapiens
cattggaatggcactcagggcaaaggcagaggtgtgcatggcagtgccctggctgtccctgcaaagggcacaggcactgggcacgagagccgcccgggtccccaggacagtgctgccctttgaagccatgccccagcgtccaggcaacaggtggctgaggctgctgcagatctggagggagcagggttatgaggacctgcacctggaagtacaccagaccttccaggaactggggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacggtcaggccggcaaccagccccacccagagagggtgatgccaagcctgcctcccaggcactgcctgccaatgtcacacggcgcccacgtgtcccatccccaggctatgggccccacatttcttacttgggattgtgatgtgataaacacgtttgcaggttgccatggttggaatggggggttcctttctgtggaggactcagggaaaggggtttggatgggcattaggatttgaagctgagcttctgaagtgtcgccttgataggtcctcaggtagaataaaggccctgggcactgtctgc

SEQ ID NO: 55774 - DNA, 825 bp, Homo sapiens
gcagctagtcttccctattgacaggtgaaaaagcaggtccacagctgttgagtgactttcccaaggccacacagaccacaaatcctggctccaagtccagggcgtttccagtaagcactgtccaaatcagtcatggaggtccctgagtgacaaaaatatgcaggaccccttctttccccctcccagttcccgcagctaggctgagtgttaagaggaaggtgccatacaggttcagcaccctggtcagcgcccagcctccctaaagccgctggaggaggcctttggagccagctcaggtcagtgtctgctgcttccttacccaggatggcccactcttggggacagacaggcatcctgagaggagggggcctggacctaggtgtcttgccacccaatacagagccctgccctctccctctccttcagaaggaagtatgggagcagttccatcctcaaggtttcttggttcccaggacagaaatttgagtgagaagcatgtgaagagagggatgcccaggggcccttggccatggtggccttggacaagtttggctttccccatctgtaaaatgtagataaggatggacccacctccccaagatcctgcctatctgtgagagtccatgactaagtgggccatgggctggactgagttcagtgctcccccaacctgccctcctcctctcccccacagagcttcccaatttacatgtaaaccttgggcatcaaagtgacagctgatagcccaggtttgcccacaaatgtgctctgactggcgtgcatgttattaaatttgataagatgcatgatggcagctattagagt

SEQ ID NO: 55775 - DNA, 339 bp, Homo sapiens
gggcactgacttcctgggagtgtaagtgactcacctggaccccacagccagtgagcattagtgcttatattccatcctccaaagctctttcttcataccagaccacacatgtggcccaaggagggatatttactctgcacttttagagttctagaaaacattgtttagtggtctggcatcatctatatttacttggcttgatttgggatagagtataatcctagtcctcgatgaaaggattttgatgagttaaccttatggggtgatgggatttatgggattatttccacacttaaaatgatttgtgggaaaaaaaagtgtactaatccctaatttagg

SEQ ID NO: 55776 - DNA, 2696 bp, Homo sapiens
ctcgtgcaattcggcacgaggctggacgggcacaccatgaggctgctgaccctcctgggccttctgtgtggctcggtggccacccccttaggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcacgcttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgatctctgtaagtgctttatatattatggcagtactgattgaggaataaccttgaatcctttttttgggtaggtaggttggaaacactgatacttcagcccaggtattgactaaaatttccatgttaaaaaccaatactacagaatggtgggatacaattattcacttatcaaattgtcagacaaaaggaacgtgaatagtagtactatttcacattgttaaagacaacataaacttcc

SEQ ID NO: 55777 - DNA, 726 bp, Homo sapiens
ggccaggccagctggacgggcacaccatgaggctgctgaccctcctgggccttctgtgtggctcggtggccacccccttaggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagagcagagcctctagcctcccctggagctccggcctgcccagcaggtcagaagccagagccagcctgctggcctcagctccgggttgggctgagatggctgtgccccaactcccattcacccaccatggacccaataataaacctggccccacccca

SEQ ID NO: 55778 - DNA, 1158 bp, Homo sapiens
  misc_feature (5)..(5): n is a, c, g, or t
  misc_feature (9)..(9): n is a, c, g, or t
  misc_feature (11)..(12): n is a, c, g, or t
  misc_feature (893)..(893): n is a, c, g, or t
  misc_feature (909)..(909): n is a, c, g, or t
cgccnctgncnngcccataggctgctgaccctcctgggccttctgtgtggctcggtggccacccccttaggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcaggtgagggaggctgcctgggccccaacgcaccctctcctgggatacccggggctcctcagggccattgctgctctgcccaggggtgcggagggcctgggcctggacactgggtgcttctaggccctgctgcctccagctccccttctcagccctgcttcccctctcagcagccaggctcatcagtgccaccctgccctagcactgagactaattctaacatcccactgtgtacctggttccacctgggctctgggaacccctcatgtagccacgggagagtcggggtatctagcctcgttccttggactgttcctgttccctgcactgtgggacnggccagtgctctgggncgtgggcagccccacctgtggcgctgaccctgcctcccccgactcggtttctcctctcggtgtctctccttgcctctctgatctctcttccagagcagagcctctagcctcccctggagctccggcctgcccagcaggtcagaagccagagccagcctgctggcctcagctccgggttgggctgagatggctgtgccccaactcccattcacccaccatggacccaataataaacctggccccacccca

SEQ ID NO: 55779 - DNA, 2095 bp, Homo sapiens
aaggctggggccttcgagtacaagtgtgggaggcagagtggggaggggcaccccaatccatggcctgggttggcctcattggctgtccctgaaatgctgaggaggtgggttacttccctccggcccaggccagacccaggcagctgctccccagctttcatgagcttctttctcagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcacgcttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgatctctgtaagtgctttatatattatggcagtactgattgaggaataaccttgaatcctttttttgggtaggtaggttggaaacactgatacttcagcccaggtattgactaaaatttccatgttaaaaaccaatactacagaatggtgggatacaattattcacttatcaaattgtcagacaaaaggaacgtgaatagtagtactatttcacattgttaaagacaacataaacttcc

SEQ ID NO: 55780 - DNA, 741 bp, Homo sapiens
ctcgtgcaattcggcacgaggctggacgggcacaccatgaggctgctgaccctcctgggccttctgtgtggctcggtggccacccccttaggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccaccaaacacatacaacacacacacacacccgacaaacaaaaaaacccaaacacaacaagaccacaaacacacaacaaacaaaccaccaaaacccctgaagctccggcctgcccagcaggtcagaagccagagccagcctgctggcctcagctccgggttgggctgagatggctgtgccccaactcccattcacccaccatggacccaataataaacctggccccacccca

SEQ ID NO: 55781 - DNA, 864 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtatttaccagaaaaaaatatataaaataaaaa

SEQ ID NO: 55782 - DNA, 774 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaaaaaaaaaaaaaagaaaaaaaaaaaccaactccgtggcgggagcgcctctggggacccctgagagaaaaagattcttcaggaaccacaccggtagtaggagccccggggcaccccatgtgagacagtccggacccggtggagcacgacgggttccccacagggagaacgcgcgggcgacgtcaatcagcgggcgggaattccgacgcccattaaaaacgccccggggaaacccggaggccctctgaaacaccccgag

SEQ ID NO: 55783 - DNA, 558 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcttaaaaaaaaacttaagcaagcttatgcatgccgccccaaat

SEQ ID NO: 55784 - DNA, 542 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcccctgtaccgagctcgattcactgcc

SEQ ID NO: 55785 - DNA, 390 bp, Homo sapiens
ccctttcccccgtatttccctttccgcacgccccccctttcacctcagttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaaaattacaaacttggcccttcttggctctcaa

SEQ ID NO: 55786 - DNA, 308 bp, Homo sapiens
gaaagaggaccctgctgtatcctcagaaaacaatggccccctttcctccattctcaatctgctttcttcataggaggttgacaaaaacaaggatgacgagctgacgggcttttagcagcatgtacccaaagtgttctgattccttcaactggctactgagtcatgatccttgctgataaatataaccatcgtgtggtggtatgcaccgtgtagctacttgtgaggctgaggcaggaggattgcttgagcacaggattttgaggttgcagtgagctatgactgcaccactgcactccagcctgagtaga

SEQ ID NO: 55787 - DNA, 837 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55788 - DNA, 776 bp, Homo sapiens
gcaccaataggatcctcccgaatcaaccctgacttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55789 - DNA, 862 bp, Homo sapiens
gcaccatcagaatggcatatcagcgcaagtaggtctacaagacgctacttcccctatcatagaagagcttatcacctttcatgatcacgccctcataatcattttccttatctgcttccttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55790 - DNA, 923 bp, Homo sapiens
tcggcacctaaaatgcgcgttgggggtactgctaacgtcaccctcacagggatgccacggggcctgttattcgcaagctggttttctagacctgttcgctggaagcctggtgagcaccatttctggacgctcaggccgtgtcgggcttcagtcatctccaccacacaggtacagcagcgcttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55791 - DNA, 850 bp, Homo sapiens
cctcaggctttgcaattgatgttcagagggtcactggagtgagagggaggaggggggcgtcttggaaatttccatttctcttttcaaacccaaaataggaatgactcttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55792 - DNA, 873 bp, Homo sapiens
cctggtatccagtaagtaccaagtcctcattttgtccgggaagacttttgaatactttcaagtgcatatatttattatcacctgctcgtaccttaatgtagtaatttgttccagcaacaacttgagttttatactgcacagcttccaattttccgtaagtctcatttgtttttttcttcaagctgtggtttaagcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55793 - DNA, 496 bp, Homo sapiens
gcaccaataggatcctcccgaatcaaccctgacttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatctatgccattcttgctgggggatcctgctatgagatcgatct

SEQ ID NO: 55794 - DNA, 669 bp, Homo sapiens
  misc_feature (36)..(36): n is a, c, g, or t
tcacacataatttccgctttttattaattacgggangctggggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55795 - DNA, 673 bp, Homo sapiens
tttcctccccatcttacactaatgccaattatttaacggcttttcagttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattt

SEQ ID NO: 55796 - DNA, 616 bp, Homo sapiens
gcaccaataggatcctcccgaatcaaccctgacttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatctatgccattcttgctgcagcaagaatggcatatcagaccttgtgaaggtgactctgacttctgaggaagaggcccgtttgaagaagagtgcggatacactttgggggatcccaaaggagctgcaattataaagtcttctgatgtcatataatttcactgta

SEQ ID NO: 55797 - DNA, 650 bp, Homo sapiens
gcaccatcagaatggcatatcagcgcaagtaggtctacaagacgctacttcccctatcatagaagagcttatcacctttcatgatcacgccctcataatcattttccttatctgcttccttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgtatgccattcttgctgcagcaagaatggcatatcagaccttgtgaaggtgactctgacttctgaggaagaggcccgtttgaagaagagtgcggatacactttgggggatcccaaaggagctgcaattataaagtcttctgatgtcatataatttcactgta

SEQ ID NO: 55798 - DNA, 800 bp, Homo sapiens
tccccatgcctctttgctgtttgtggaaaataaagcattctataggcggagctagtgaacgcctcttttaaaacacgagtctccacacttccctgttcactttggttccagcatcctgtccagcaaagaagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtatttaccagaaaaaaatatataaaataaaaa

SEQ ID NO: 55799 - DNA, 1021 bp, Homo sapiens
tcggcacctaaaatgcgcgttgggggtactgctaacgtcaccctcacagggatgccacggggcctgttattcgcaagctggttttctagacctgttcgctggaagcctggtgagcaccatttctggacgctcaggccgtgtcgggcttcagtcatctccaccacacaggtacagcagcgcttcctgatatgccattcttgctgcagcaagaatggagcatatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggttagagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatagaaaaagatttcataacagttcagggcatgctggatttgtggctgtgctgctgcttaggtaaggagggaggatcacgtctcatctgcctgaaggtgtggggctggaccacatggtatcttgaagctgattctacctcaaagctgtatgattctctatgtctaaattaaataaattaaagtaacgactcaaatcattagctgggaaaataatttaaaccttttttgcccttcaattaatataatgtaaatactattttgtaactcaaattagatttaacttgtggcactctaggcatagtttaaaagagtggagtatttaaaatagtttaaaagttaattttatagctctgtcaaaaaattacacaatgcattgatcgagttctaatt

SEQ ID NO: 55800 - DNA, 424 bp, Homo sapiens
ctagtctgctctttttctcctaaaataaggtggtggatttatgaatacaaagagtctaagaatggtggactaggtctagcaatgctgttcctcagcagctttttggacagaagtctttgtagacctgtggctctctcacttgatgtagacccatttgaatgaatctccttttgctttctctttctttaatatttttcaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttcc

SEQ ID NO: 55801 - DNA, 479 bp, Homo sapiens
caagcgattctcctgcctcagcctcccaagcagctgggattacagacatgcaccaccacacctggctaattttgtatttttaatagagatgtggtttctctatgttggtcaggctggtctctaactcccaacctcaggtgatccgcctgccttggcctcccaaagtgctggaattagaggggtgagcctccgtgcctggccttatataaatatttttatatatctcattattgcatcaggataaattcctatacgtggaataattgggttagattatgtaagtattttgaagcctcatggtatatattggtaaatccctatctggaagtttatactgtttgacgcaggagttaaggaactaattttatagaagaaaatattcgccagacgtggtggcccacacctgtaattgtaacactttgggaggccgaggcgagaggatcactggagcctaggagtttgaaaccagcaatctctta

SEQ ID NO: 55802 - DNA, 310 bp, Homo sapiens
aacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaa

SEQ ID NO: 55803 - DNA, 194 bp, Homo sapiens
tcacatggctagcaagcaggccaggcaggatgagagctcaggccttgtgacttcccgttcagtgctctccactgttcctctcagttgataagtggtcctgagaccacctgtgctccttgcagcctagtaaacccccttctctcttatttatttatttttgagacactctcactctgttgcccaggctggagtgc

SEQ ID NO: 55804 - DNA, 496 bp, Homo sapiens
gaaatctgggagtgtagagtactcattaaaactcaaaacatttgatttcagacttggccgaatttactaattttgtcatgtttttcctgaagatcttgtgtccattgtcaaacagttttgtcttctgattagacttcattttttaacctcataggctaatggctgaattttgatttactgttgtcagtgtaagcactatactatgttatctattataagaataaggccaggtggtgtggctcctgtaattccagcactttgggaggccaaggcgggaggatcacttgaggccaggagttcgagaccagtctggtcaacacagtgagatgccatctctacaaaagaaaaattaaaaaattagctgagcatagtggcatgcacctctcgtaccacctactaggaaggctgaggcaaggggattgcttgagcccaggagttcgaggctgcagtgagccatgatctcgtcactgcattccagcctgggtgacaaaaaaaa

SEQ ID NO: 55805 - DNA, 372 bp, Homo sapiens
ggcacgagggagctccaccttgatggttctggactcccttgtatctaagtgtgaccatgtggctggttcttgtcaatggctatgatgtgagccgttatggagaagcaagctcttctttttctttgtgacctggacgtcaacacccaaggcagtcttggaaatagcatgtattgaagatgtcagagcctctgtggacccacgtttgtgagtgactgcctgtggccaaggacctcatcatctgccctaccaccatcatcatggggcttcgcaaaaacaagaaacaagcttttattgggttaaaccactgatatgtcaacagatgtttcaacagttggtgctgtcataattaatacatgtatccatccttttaat

SEQ ID NO: 55806 - DNA, 322 bp, Homo sapiens
gtcttttctttttctttggaaagtttgtttactaatggagtgatttcttcctaaatatttggtagaacttggtaatgaagccttctggacctgaaatttactttgtgggaggatttttcagtattgatttttgtttttatgggttttgttttttttgtttgttttaatgcatagtgtcactgtcactcaggctggagtggcagtgatgtgatcataactcactgtaaccttaaactcctaagctcaagtgatctcctgcctcaccttcctgagcagctaagactgcaggcatgcaccaccatacctgcctacttttcttttt

SEQ ID NO: 55807 - DNA, 908 bp, Homo sapiens
gaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaa

SEQ ID NO: 55808 - DNA, 600 bp, Homo sapiens
  misc_feature (18)..(18): n is a, c, g, or t
cagcatcaaacaaacttnacctacaccctccagtaccgtaaacatcacaaggtgatatgtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaa

SEQ ID NO: 55809 - DNA, 441 bp, Homo sapiens
aaagcaattgctgttaagaaaaatggcctgaagaacaggtcatacgactgctacagaactgcaaggtgtttcagggacaattggattgtttggccatatcaaccattcaggctttgaccgcagtaatgaacaaatctccagctgctaaggaagtatttaaagaaagaattggttatacacatatgcttgaagtattaaaatccctgggtcagccaccactggaattacttaaagaacttatgaatatggctgtagagggtgaccacacttcagttgggattttgggcattagtaatgtccaacctctcttgcttcttatccagtggcttccagaactacaatcccatgacctgcaatcttcatctctgattggctgaaaagaatttgttgtattaatagacagagtcgaactacttgtgtcaatgcaaacatggggattag

SEQ ID NO: 55810 - DNA, 302 bp, Homo sapiens
tttctttccaaggtgatttccatattccctaatagtgccaccaccttctcggttttcttcccctaaggtatcttcgatttttctcatctccatatctgctagccatgaagacctacttatttctttgatcttcatctctataattgttcttcatcttctgtcgaagtgaagactctcatctctctcgggctgtaattgtggccccttctacctctagtcttaactaccagtctatctccactgctgccagagtgaaatttgtaagatggaaatccgaacttgttacggagaactcttcattg

SEQ ID NO: 55811 - DNA, 480 bp, Homo sapiens
atctgtaacataaggataatcatagtgcccacaattgttgggaggatttgttgagttaatccttgttatgcacctagtctagtgccaagttatcattattactattgtcattatttttaataatccacgagtttataacttcagagtgttggaatcataaccagttcacacaatacttttgtacaagttataaaaggcatttttcctcaggacaatttattatttgtctttcaaagtaattataataatataatgattttgttagaataagacaattttctatcaaattccataaaattattgaaataaatatacaaatccatagtatctacaatgttaacacctccctttaaggttggaatgtgcacagtcttgtggtatgtggcagttttgtgtgacaatatatgaccttgcagagtgcactaaaatcattcttctttccaacaagaataaaataaaggaaattattgatctagaaaa

SEQ ID NO: 55812 - DNA, 292 bp, Homo sapiens
tgctaagcactttgcattcatgatagacgttagcttcctgagatactgtaaggttggcatcgttattgccatgtcagatggtggagtagggcttagagacagataaggttgcccaagaccaaacagataatacatgtgctagccagattttggtcaaaattgattttgaattttatcaagttagtgtacaaacacagttgaaataatcaaaaagtcccaaaagatttatggtttaaaaagaaaacaggccaggtgcagtggctcacacctgtaatctcagcactttgggagg

SEQ ID NO: 55813 - DNA, 258 bp, Homo sapiens
ttaactgaaaagacacttaaggaaaacctaaagggacagaactggggcataataatgccaggctgcctagatgctgaggctggagatgaggctgctcccagagtagctctgggccaccagcattactgtgtcacgttctgcatatttgcttttctctcagcccaccacctcttgctgcccagtttctgcttcccagacacatgcgtcatcgtgacatctctaaccctgatgatatcatttactcttcacctgctgtgt

SEQ ID NO: 55814 - DNA, 994 bp, Homo sapiens
caaaaaaattgttttaattatttttggcttcatgtttttaaatttaatcaccattaggttaatgtggagttatgctaaaaattatccacctgaaaatgtccactctttctgatcatcttaatgaaagctctctcattccgcagagaaagatagaaactaagtttgctgcctattacaaggaaggaagaaatagtttatttttatggataaatgtaataaatcttatgatggattatataaagggaaccaggaggagttaaaatatacaaggcaaattgtagcatagtgactttgaatggtagctacgtgggttaaattaacaacaaattattaatattgagaccctaacctgcctggtcttaagttacaaccacactcttctacttgaagaaattatatattgctaattaaaacttcatttctcaatatatggtggtttccttagaacttttactaaatctcattacataaaaagccattcagaggctttgtgtttagttattagctactttaatagacactaggttggagggcatatgtacaaatgatagtctgattcattggcagaatttatgtgaaattggccctgccacagttaacttggttttatcaaagcaataaatttaatttttatcaaatctgtgcttcacaccatttatgagtcccgtactgttctgaaacaatgaatcctttatgatgatgactaagatgcatgtcatgaagctaaatgctcttacattagcctactgagtcacacatccctgaggttgcttagtcatcttgatcattgcctggctggctctcacatttacaagggaatatttccatcagtcttttctacctcattgttcattatttcatccctacaagtaagattaaattttcttaagtagattcaaaacccaaggataaggttgcatgcacataacttcctatagtaaatattatatgggtagattgtaagttttagttgtatgaggttgttcccctcacc

SEQ ID NO: 55815 - DNA, 336 bp, Homo sapiens
tggcttcaggtggggggatgaagttaggattgctttaagtcagtgtcccagcgtccctgtgtggtggaggtgtgaggtgggagagggtgccaccaggctaattatgttgtgcttgtctctcacttttcttatctcacttttctccgtttagccccgtttagtcattgtgtactttttgccgacctgggccaattgaacgcatatttactaaatatgggtgggttttttcagtttataaaaagcaggttcaaagattttcatttaattatctcattgattgagactgcttttgcagcttgttaactagaccatctaagtgataaccagtaaagatag

SEQ ID NO: 55816 - DNA, 2730 bp, Homo sapiens
acggtaggttctggaacgcagccgctgaggggtctggcgccatgttggggctgaggggaaggaggagaagctcctgaagcggcgggcgcgcagcgggagtgggagtggggtcggaccaggcagctagaagccctgcccttccgcctcagcggatcatgacccgggcggcggccgcgaaggtcgcggtggtgggggacgtgccctggcggggcgggcgctgaaagatgatgccgtttccggtgacaacccagggaccaccgcagccggcgccgccgccgaatcgctacggcgtctcctcgcctatcagtctagcggtccccaaggagacggactgcctcctcacccagaggctaatagaaaccctcaggcccttcggggtcttcgaagaggaagaggaactgcagcgcaggattttagttttggaaaaattaaataatctggtaaaggaatggatacgcgaaatcagtgaaagcaagagtcttccccagtctgtaattgaaaacgttggaggaaagatttttacgtttggctcttacagattaggagtacatacgaaaggcgcagatattgacgccttgtgcgttgcaccaagtcatgtggatcgaagcgactttttcacctcattctatgctaaactgaaactacaggaggaagtgaaagatttaagggctgtcgaggaggcatttgtgccagttatcaaactgtgttttgatgggatagagattgatattttatttgcaagattagcactacagactattccagaagatttggacttaagagatgacagtctacttaaaaatttagacattagatgcataagaagccttaatggttgccgggtaaccgatgaaattttacatctagtgccaaacattgacaacttcaggctgactctgagagccatcaaactgtgggccaagtgccacaatatctattccaatatattaggtttcctcggaggtgtttcctgggccatgctagtagcaagaacttgtcagctttatccaaatgcagtagcgtcaactcttgtacggaaattcttcttggtattttcagaatgggaatggccaaacccagtgttactgaaggagcctgaagaacggaatcttaatttgcctgtatgggacccaagagtaaatcccagtgataggtaccatcttatgcctatcatcacaccagcatacccacagcagaactccacatacaacgtgtctatttcaaccaggatggtcatgattgaggagtttaaacaggggcttgctatcacacacgagattttgctaagtaaggcagagtggtccaaactctttgaagctccaagcttctttcaaaagtacaagcattatattgtacttctggcaagtgcatcaacagaaaaacaacatttagaatgggtgggcttggtggaatcaaagatccgaatcctggttgggagcttggagaagaatgaatttattacactggcacatgtgaatccacagtcatttccagcacccaaagaaaatcctgatatggaagaatttcgtacaatgtgggtgattgggttagggctaaaaaagccagataattctgaaattctcagcattgatctcacctatgatatccagtctttcacagatactgtttataggcaagcagtgaatagtaagatgtttgagatgggtatgaaaattactgcaatgcatttaagaagaaaggaacttcaccagctgctgcctcatcatgtgcttcaggacaagaaagcacactcaacagaaggtagaagattgacagatttgaacgacagcagctttgacttgtctgcaggctgtgaaaacagcatgtctgtgccttcatctactagcactatgaagacaggcccattgattagcagttctcagggtagaaacagtcctgccttggctgtaatgacagcatctgtggctaacatacaggctactgaattttccttgcaacaggtgaataccaatgaaagttcaggggttgcattaaacgaaagtattcctcacgctgtctctcagcctgccatttctccatcaccaaaggccatggtcgccagagttgtttcttcaacatgtctcataagccatccagaccttcaggaaactcagcaacaaacatatctaatcctatagttggagtctagaggatattcttgcctcataaagaagaaaggaccaagaaaaccaaaacggaagaggagaaactcaatacaaagacaagtacaactccattagaaaaattcagacagcatcttctctattggcctctcagggaacatcagtatagatctttccggtatccctgttctccctgcaaatccaattcctgttatcaagaattcagtaaaacaggttgaatggttaaaaacaacctcaagggtccatgaacaatatctgccaactgaacctgttgtcttcaaatactaaggaaggagaatgaggggtacgggactagatatgacttgaaatagattgaggctcatttggtaacttcctttactgagccagtcttgatcagaagtccacattagtatgtgacagctagaggtactgttattaatgtatcagcaacagttacattaactatttcaaaggactactgcccttaaaatgaaaaaacctttcagctatgtttgtacccgtgactgacatctggactggatttatgcttgatgcattgttgggaaaatatgcaatacaaactggtatcagaattccttatact

SEQ ID NO: 55817 - DNA, 320 bp, Homo sapiens
tgtgtgccttgggcggcctgtggtttctgagaatttgccatgaaaattgtactcagctgctgtgcgaagagcagcagagattcatgtagtaatctcccgccctgccacctcccaggatcccagagccccccaggaaccgcccctaggatgggagaaggaaaggcagggggagaggaagactcccacttgatattgagccacctggctttgtgatcagatcctttgaaagaccacgccgggattccccaggtccttcagagcagaatgtctttagaaatgaaccccaaaggtgtccgttccggaaaagccaacgttgctca

SEQ ID NO: 55818 - DNA, 547 bp, Homo sapiens
gatcacaccacgaccctccagcctggacaacagttgcaatcctcctgcctcaatcccccaagtagctgggactacaggcacccaccactacagccggctaagtttttgtatttgtggtagagacggggtttcgccacattgcccagactagtctcgaactcctgagctcatgcgatccacctgccttgggatcccaaagtgctagaattacaggagtgagccacggtgcctggcctattatcaaatttttatggatgagtaccttatcttctcaactagactgcaaatattctatagacttcccatctactggtagtggctctgagaaccctgcacactgctatctatgtatgctcatattagaaactcaatacgtgctgcattaaatttgaatatttaaatactagataagacaggaagagaaaaaccacacctacctattgccaaacatttaataactcaagaggagagagatttttcccaaattattcaatgacaatcgaatgaagtagttaaatgatgcaaatattcactaccttggtgacag

SEQ ID NO: 55819 - DNA, 305 bp, Homo sapiens
ggtgggagtgggggcatgtacgctccctcagtgtctctcgcccattctgcagttttgataaggtggtgggagtgggggcatgtacgctccctcagtgtctcttcctgcctgcatctttgggataagtctgtgacctctgggaacagaagagtcctgcagtgaatggcttaagatggtcctggccacatggagaaatggtctcttccttgatgacctcttgggttgggtttatctctccctgttcttttgtaccattagaatagtaacatcttaaggactgagaatcagatatcagcttagaggga

SEQ ID NO: 55820 - DNA, 528 bp, Homo sapiens
cagtctggttggattacacacaaagccctgcagatctgctgcttttcctgattctcctgtcctgagtgagtgcaaggggctcccctgtcgccgatgtgttctttgaagcagatgctgtgcctgatacctgctggagagtcccaccgccttgagcttctgggtcgagaaaggccaagttgcacactactgagagactgccatgcaccccctggaggcctcagaacattcgacatgctccagtcatggccacggcagtgactgctgattgcctaaccccacatgtgttctcccccttccctgataatcaagcccctgattttcagctgggcacaaaataattcttcctagaacaactccacgtgtgttatcgcccttgcagctgggggtggccaccactggggagaggcagggtgaagaggtcgaaggagcctgagttagcagggatgagcagtggccaggtaaccccagacccattatcctctggatttcttttatgtgaaacaataaaatgtcttgtattcgaaactt

SEQ ID NO: 55821 - DNA, 260 bp, Homo sapiens
ctccagaagggggactgatggcactggttctcctagaaagggcaccaggggactggggacggggtctggacccaggactcgatatctttgtggactttctgatttttgaaccatgcaaatgaattacctgttcagacacacatggagcaatgagaattgcaccaagagctacacatcctttaaagcaattggaggaggaacaggactttcttccaaaggctggggccaggcaatggtgttgggtccctcaacaagcgtgt

SEQ ID NO: 55822 - DNA, 327 bp, Homo sapiens
atatacaaaatatcataaaaccaaaagaagtagaccccaaagagtatatactgtgttgtttcatttatatgagattctagaacaggaaaactaatgcacagcaacagaaaccatatccatcgttgcctgtgtgggccaaggactaagagaaagtgaaaatgagaagactttcaagtgtgatggaagtattttacatcttgattttaagtggtagaaatagagagcacacattcattaaaactcattgagttgtacacttaggatatgtgcacttcactgtatgtaaattttacctcagttaagagaggatacaggagacaagtgact

SEQ ID NO: 55823 - DNA, 291 bp, Homo sapiens
caaggcctagtagcttaatgtgcaaatcacaaggctggggctctggaggaaatcctagcctttgaggagtggcagctgtgtaaaaactcaacagaggaaggacaaactgtgttctctccttctcaccattgccctctgtcttcctcttcttcactctcagcctatgtgaaaaaatcagatccaggctgggcacagtggctcatgcctgtaatcccagcactttgggagcccaaggcgggcggatcacgaggtcaggagttcgagaccagcctggccaatatggtgaaatgc

SEQ ID NO: 55824 - DNA, 253 bp, Homo sapiens
tcaacatttggaagatctgtgtaagtcagtgaaaactgttttccaaatggccagtgcatgacagaaaaattatgcctggttaaaagatccattaaaaatgcaaagtaggctgggcgtggtgcctcacgcctgtaatcccagcattttgggaggctgaggcgggaggatcacctaagtgtaggagtttgagggtccagtgagctaagatcatgccactgcactcatgcctgggcaacagagcaagactctctta

SEQ ID NO: 55825 - DNA, 310 bp, Homo sapiens
attaatgttaatgccctcaagtccccaaggatgggtacatttgtgtgatgtgaaataatccaagaactttataaaaccaaggagggatacttgcttatttgtaagcctagagacccaagtatctagctactttggatccctgaatgactgcatgccctcagaggttacatttattttagtaaacctatggatatggataaatacaacatttcctaatgtagcactttgataaataactaccaatgtctggattttttacttcctctgagctaaggaagccaatatggtcttaacaaaagcttcaaagata

SEQ ID NO: 55826 - DNA, 5142 bp, Homo sapiens
  misc_feature (4740)..(4740): n is a, c, g, or t
  misc_feature (5096)..(5096): n is a, c, g, or t
caactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagaggtaccgtcctgggaactgtaaccatcgtcagctcagccatggcctgagagtggcagagggatgagtggagggatgagtgcaggaatgtgggagacttgaggctacccgcccgatttgccactgtgaactgtgtgttttctgacaagtcctcagctttcccaagctagaattccttgtatgcaaagcgggagagatgtaagagatggtctctaagtcccttcaggtctacattctgtgattcaccttgatgtcctattggcataaagaagaaattattacaggggctgcaaactcataggatgctgtgaggtgcctgaagacagttaagtataagaaaatantgtagtgccagggatacaacaaggagagatggcaactgtgacaaactagcacatgctgtgtgaagggagcagaatctctttcactccagctgtggccatgcagaaatgtggtctagcgttaccagacctgatttttcaagagaggctaaaaatctggactagtatgtgagatttcctaacttgaaaatgggggctgaaatttttggttttaaaacattgtaaggggcaaacaaacccctttcatgaaccagatgtgttgtgcctgtttaacaaacagcttcagaggaagaaaataattttctataatatccgaagtatctcaagtaccattttttcatatatcttcctgtgcacantgcttatctagaccctttttaatggtaataaaccagtagtaatcat

SEQ ID NO: 55827 - DNA, 1062 bp, Homo sapiens
gtcaaaagactttttggttgttgtttattgatgatgataatatttgaacatgtccatcatttatggggtaactctatcatgttacagtacattcttttccagtgtaatcaatgggaaatattattcatgtagctctaatgagcattaaatggccattctctatagatagggtcatcacttgtgttcaggaatcctcccattacacccaggacataatgactttaaaagtctggtttcttgtgggtcacaaactcattcaatccaattaatacaattgagcccaaacaatagtagctatgttgatccaaaatattttcttctgttcagctagctttgatgtgaacatatggttctcctctctggcatagatttatgtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaagtaagtagagccacaaaggggtacctgccaggcatttcacgtgtgcgccccttgctatcctcacatctgttccctataaagccagagaagtcaccgagcacggttacaatgctggctctttcccaaaaggttcactgtcagactcgcgcattcgctccaacaagggtgggagaacttcttgtttttaagcaattcctacgtctgtctgtattcctgagtgttccaagtctggccgcctcaaaaaaaaaaaaaaaaactttaacaggctgtgggccgaatgcattcagatatctttcacagaaggagggggagatagaaggaatattttaaatacgtgtctccagatttggtcattctgtatctgtttaaatagccgcagggcagactttaggtagaacctactctgtatttttcctctttctatgactttggctgtcaggtagaagataggcattcatgtgaaaccttgattaattagtgaaagatttctaacattt

SEQ ID NO: 55828 - DNA, 627 bp, Homo sapiens
gctgagaagatgccagtggaagcaccagatcccagaggcaccctgtagggttgcctgtctcctgtgcgctcagggcctgccacttgaaatgaataaataagctaatgaagtgggagctttctgcagcatagtcacacggtcagcgcttggtgtggaggtcaggggcctattgtgggctgcccccaggaactgctcgaacctctcctctcaatcctcctctcaatccctgtctttgcagtgctcagtgacctgtggagaattatgaatacagctaccaaaccaccatcaactgcccaggcacgcagccccccagtgttcacccctgttacctgagggactgccctgtctcggccacctggagagttggcaactgggggagcgtaagtagaagactgagcactcaaatctgaaagcccttggatctcaaccccgtcttaaacatgtcctgcctaacccgctctccttagtaactctacttccaggagaaaccctggagttagcaacttgaaatgggctaacagggatcaaagggacttctttctgtttaccaaagtggcttcgtgcttagaacatgggctctgaagccagacagtctggatctgccctggttctgccacttcccaggtg

SEQ ID NO: 55829 - DNA, 938 bp, Homo sapiens
aagtgacaaggaaactgcatttaatgaattttaaggactctaatagctacctgtcgctggtggctaccatatcggacagggcaacctcaggcaacaggacatctctaacaattaataacaaactagcaaagaaatcaataaatttataaaaaaaaattggggagaaaaaccgtattccacatgtaaggggttcccccataggatgcccatgcatctggtgattagcattctcttgcctttcttgtgtttcgtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaagtaagtagagccacaaaggggtacctgccaggcatttcacgtgtgcgccccttgctatcctcacatctgttccctataaagccagagaagtcaccgagcacggttacaatgctggctctttcccaaaaggttcactgtcagactcgcgcattcgctccaacaagggtgggagaacttcttgtttttaagcaattcctacgtctgtctgtattcctgagtgttccaagtctggccgcctcaaaaaaaaaaaaaaaaactttaacaggctgtgggccgaatgcattcagatatctttcacagaaggagggggagatagaaggaatattttaaatacgtgtctccagatttggtcattctgtatctgtttaaatagccgcagggcagactttaggtagaacctactctgtatttttcctctttctatgactttggctgtcaggtagaagataggcattcatgtgaaaccttgattaattagtgaaagatttctaacattt

SEQ ID NO: 55830 - DNA, 6825 bp, Homo sapiens
caactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcaccggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttgggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaaaaaaaaaagttt

SEQ ID NO: 55831 - DNA, 7027 bp, Homo sapiens
caactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaaggtgaatgtcagacaccagtcattatttcaagaatgtttttagagtgagtgatcaccgctctcattacctcatttctgagccactcttcatgggttatttatggtctttcagatattctgtgcggggatgcactctgaccaccccaaagagtacgtgacactggtgcatggagactctgagaatttctccgaggtttatgggcacaggtaggagagccaggctcagaagatctcagaggcctggagatccctggaaatgctttcccatccttaccagaacattctctgtataatttaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcaccggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttgggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaaaaaaaaaagttt

SEQ ID NO: 55832 - DNA, 5532 bp, Homo sapiens
caactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggtgctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgagtgcaggtga

SEQ ID NO: 55833 - DNA, 432 bp, Homo sapiens
tccttctggcccttcagaaatgcctctacctagaactcccttaccttgctgtagaacgtgggtactgcttcagcttcccccgtccaaagaacccaaaacttcctaccttcagtagtgactccaccccagtgtccacctaggatcccccagtctggagacaggcctggctggaaagccagaaaggagcaccagctatgtcccaggtgctatccacagcacctgccaggcacacaccagggctcaggtcatgagaaaataggacagaaccagcattcttatgaaaatatgctaaatacagccgagaggatctaaactagtaccggcaacgtaagttgctttggatataagtgctgcacttgcttcctccagtggagaatctaccgaaggcatgcaaggtgcggggatcgagggaaacccaccacaggaatgagc

SEQ ID NO: 55834 - DNA, 156 bp, Homo sapiens
gccgcggtgcggtcggatgcccagctcgcgtccagacccgcgggatgcagacccggatcagtcaggcttgagggctgctccgcatagaccaacgtccggggaaggcacacagtggccgagggcccgcgcgcttgggctacggctgtgatggtatct

SEQ ID NO: 55835 - DNA, 841 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgggtctcactcagtcgctcaggctggagtgcagtgtcacaatcacagctcactgaagcctcgacctcctgggctcagaattggttccttccgatgggttcttggtctcactgacttcaagaatgaagccgcagaccctcgtgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagaggtaagctaaattttatcctaaaagttcttcaaataaatatttgctatcccactatacttgatatcccactatattcg

SEQ ID NO: 55836 - DNA, 4108 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55837 - DNA, 4778 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatggtgagtgcggcccctggcggccccgagccctggcccaggccggcttcctctcgcccgtggggctcggaccccggccccaggcgcttcctgcctggcgtctccgcctccagcctagttctcgggggaagccgggggtgaaggagggagtattgttattttttaatcctcgcactcgtcgacgctccggtgaacccagtcagcccgagggttttggccaaagctcgggtgggcttgaacctctcccatccgctcagcttggacccgaccccggctctgggcccgaccccttggccgacgtgcagtgtcctttcggcaaagcttccgttgcgtttccaaccccacttgccggcccccggggctgccccgggacccccgtcccgaccgcctgcgctcccagctcctctgcttctgccgaactgtccgtctctctccatggctacgtcttcagaaactcccaagcccctctaagtccagaaggtcacagctttcgggtgcctgtgctagaatctcttcaaaggtgaacaggagccaacacaccctttccttgtgtgttaaaggcaacctcgttaaaatatgaatgaggctaacatttctcaagaaaatagcccagctgaattatttagagatcctggtggtgctcctttcctacactctgaagaccactttccagtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55838 - DNA, 4054 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55839 - DNA, 4052 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatctaatccgggatctcaactttacatgtccgtcctcgctgtggtgtcttctttagg

SEQ ID NO: 55840 - DNA, 4014 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55841 - DNA, 2733 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgatttttgtatttttggtggagacggggtttcgccatgttggccaggctggcagctgggctcttaatgttacttattgtaactcacttcctgtaagactcaatctactcttcaagttgatgtaccctctatgactgtaattcctgaaatctgcagttatgctgtggtgatcttaagcgtgtcttgagttccatgcaaattcaattctgttgataatgtgtccataatcaaatcatcatcttgcaatgcaagggctaccccataattatcagacattaaaatagtttatttctttttccattctgtaatcttaaaataacatcagcttcagtgcctgttcacaatacaaaaaaagtcaaaaaacaaaaacaacacccaaaacat

SEQ ID NO: 55842 - DNA, 3510 bp, Homo sapiens
atacagaactctttctcttctgtagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55843 - DNA, 2751 bp, Homo sapiens
agccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataaccgatcgtcgacatacgggatctctagatcgacc

SEQ ID NO: 55844 - DNA, 1189 bp, Homo sapiens
cggacgcgtgggtcgacccacgcgtccgaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55845 - DNA, 1141 bp, Homo sapiens
atgctcatagctgactcttgagggtccacagatgacgcggagaaccccagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaa

SEQ ID NO: 55846 - DNA, 7686 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccgtctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55847 - DNA, 7656 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccgtctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55848 - DNA, 5802 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccgtctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55849 - DNA, 7168 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgacactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55850 - DNA, 7107 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55851 - DNA, 461 bp, Homo sapiens
ggggaaattataacgtatccaatttgaaacagggacctgcttatcaattaatagaaattaaatacgcctcatttaagaaatttggccctcaaggccaaaaattcgcacgaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 55852 - DNA, 238 bp, Homo sapiens
aacagtgcttatgtgacctacccttggagggcagagatgggccattctccatgggcccccagggctggaatggagttccaaactgcagaagaccatgcccctagaggctccagagaccgtgaactttttcaatgacacgtttgaaaatctattacaaattaatatcagtacctgattttttgaagatgaagctgacaggtattaaatgaaaacggaagcactcttaattaggaacctt

SEQ ID NO: 55853 - DNA, 601 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggtgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcagagtcca

SEQ ID NO: 55854 - DNA, 1477 bp, Homo sapiens
  misc_feature (265)..(265): n is a, c, g, or t
  misc_feature (271)..(271): n is a, c, g, or t
  misc_feature (335)..(335): n is a, c, g, or t
  misc_feature (345)..(345): n is a, c, g, or t
  misc_feature (430)..(430): n is a, c, g, or t
cgagaccagcctggccaacatggtgaaacccagtctctactaaaaatacaaaaattagccagatgtggtggcacgcacctgtaatttcaactactcgggaggcagagtttgcagtgagcccagtcgagaccctgtctcttaattaaaaacaaaaacaaaaacaaaaaaaactaggctgggctcagtggctcgcctgttatcctagcactttggcaggctaaggtgggtagatcgcctgagctcagccgttcgagaccagtctggncaacanggtgaaacctcatctctactaaaatacaaaagaaattagctgggcatggtggtgtgtgcctgtngtcccagctnctcgggaggctgaggcaggagaattgtttgaacccaggaggtggaggttgcagcgagccgagatcttgccattgcactccagccngggtggcagagcgagactctgtttctacaaaacaaaaaacaaaaaacaaaaaaaaaaaactggtagaacgttaggttcacaccatccaaagacgtttgcgtcttcttgtaggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaataggtgacacactctgcacccccgccccttcagttcatttaaagatgaaaccaatagcctaattttaattcactcgtgcatcccgcctgctgcgtttcagagctgactgttcagatgtgtcatgcttttttcattggtccgtgctgggtaatggtgttgcttttcttgcagacccttcctaggaccagagagtcagctgggtaagtgacagcttctcaggtttggtggctcttctgagctgctgaaccacttcttcttcattaaaacttgaattgggggccgggcgtgatggctcacacctgtaatcccagcactttgggaggctgaggcaggtggatcacaaaggtcaggagatcgcgaccatcctggctaacacggtgaagcccagtctgtactaaaaatacaaaaaaaaattagccgggcgtggtggcaggcgcctgtagtcccagctactcgggtgtctgaggcaggagaatggcgtgaacccgggaggtggagcttgcagtgagcggagatcgcgccactgcactccagcctgggcgactgagcaagactccgtctcaaaaaaaaaaaaacaaaacttgaatttgggtgaggggagggaacttagaggatgggccaataggtgcagcaagccattgtggcacacatgtgcctaggaaacaaacctgcacattctgcagatgtatcccccccttttttttttagaagaaataaagaatattttttaaaaaaagaaaaatacatttgtagct

SEQ ID NO: 55855 - DNA, 1222 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcaggtgtataccaaggactggaattgatgggccaagctttgtgttttaaggaaaaaaaaatcatgttttagtttcgtgctggtaatttgaagtaagcagatgtctagatataagcttggaaactggccagttggagattgctcacggctgcaattgaagactccagcagcctcttctcctctttgcttccatttggagaggaaggcgtcataggctgtgtgacttccgtggacgcggggcttggcaccggcttgcagttgggatcaatcttcagtggcggtttggagtgggtcacggttcttcctgcttgccttccagtttagtccctgacgtctgctccccagggccctggctcttcccccacgccttcagcctgcacagtcccttctctcattctcaggctgcagaacctggaagtacagttgtccccccttacccgctgtttcagttacctgaggtcaaccgtggtctgaaaatactacatggaaaattccggaaataaacaattcgtaagttttaaattgcacgctgtgatgaaatctcgcgctgtgcagcctgggcagtgaatcgtcccctttgttcagcgtccccacgctgtggacgctccacacccatagtcacttagtagctggctcggttatcagatcgaccgtcacagtgtcccagtgtatgtgttcaagtcacccttattttccgtcataatggccccaaagcacaagagtagtgatgctgggaatttggataggccaaagagaagccgtaaagtgcttcctctaagtgaaaaggtgaaagttctcgacttaatcaggaaagacaaaaaatcctatgctgaggttgctaagatctacgggaagaatgaatcttccatccgtgaaattgtgaagaaggaaaaagaaattcgtgctagttttgctgtctcacctccaactgctaaagtgacggccacagtgcgtgataagtgcttagttaagatggaacaggcactgcatttgtgggtggaagagatgaacagaaaacgtgttcccattgacagcaa

SEQ ID NO: 55856 - DNA, 1205 bp, Homo sapiens
ctttccttctttatggctgaataaaaatccatgatatgaatacacagcattttgattttccatccattgatggctatttgggtaatttccaccttttggctgttatgaataatactgctatgaacattggtgtacacgtttttgtgcggacatttgttttcaattctcataggtgtataccaaggactggaattgatgggccaagctttgtgttttaaggaaaaaaaaatcatgttttagtttcgtgctggtaatttgaagtaagcagatgtctagatataagcttggaaactggccagttggagattgctcacggctgcaattgaagactccagcagcctcttctcctctttgcttccatttggagaggaaggcgtcataggctgtgtgacttccgtggacgcggggcttggcaccggcttgcagttgggatcaatcttcagtggcggtttggagtgggtcacggttcttcctgcttgccttccagtttagtccctgacgtctgctccccagggccctggctcttcccccacgccttcagcctgcacagtcccttctctcattctcaggctgcagaacctggaagtacagttgtccccccttacccgctgtttcagttacctgaggtcaaccgtggtctgaaaatactacatggaaaattccggaaataaacaattcgtaagttttaaattgcacgctgtgatgaaatctcgcgctgtgcagcctgggcagtgaatcgtcccctttgttcagcgtccccacgctgtggacgctccacacccatagtcacttagtagctggctcggttatcagatcgaccgtcacagtgtcccagtgtatgtgttcaagtcacccttattttccgtcataatggccccaaagcacaagagtagtgatgctgggaatttggataggccaaagagaagccgtaaagtgcttcctctaagtgaaaaggtgaaagttctcgacttaatcaggaaagacaaaaaatcctatgctgaggttgctaagatctacgggaagaatgaatcttccatccgtgaaattgtgaagaaggaaaaagaaattcgtgctagttttgctgtctcacctccaactgctaaagtgacggccacagtgcgtgataagtgcttagttaagatggaacaggcactgcatttgtgggtggaagagatgaacagaaaacgtgttcccattgacagcaa

SEQ ID NO: 55857 - DNA, 1044 bp, Homo sapiens
tcagttcagcgggctgggtttcgtgttacttactggccggtggcgtccatttcacatgacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaataggtggccctgggatggtaacagatgcggagagatccatagtatcaccaagtgaaagctgcggccccatcaatgtgaaaactgaacccatggaagattctggtgggtaccaagatgcttttagaatcaagtatcggccaagcgtggtagctcacgcctgtaatcccagcaatttgggaggccgaggcaggcggatcacttgaggtcaggagttcaagaccagcctggccaacatggtgaaaccccgtctctcctaaaaatacaaaaattagccaggcgtggctgtgcgtgcctgtaatcccagctaccagggaggctgaggcaggagaattgcttggacctgggaggctgaggctgcagtgagctgagatggcgccactgcactccagcctgggtgacagagcaagaccctgtctcaaaaaaacaaacaaggctgcgcacggtggatcacgcttgtaatcccagcactttgggaggctgaggcggacagatcgcctgagctcaggagttcaagaccatcctggccaacatagtaaaaccctgtctctactaaaatacaaaaaattagctgggcatgttcgtgtgcgcctgtagtcccagctacttgggaggctgaggcatgagaattgcttgagcccgggaggtggaggttgcagtgagccaagatcgcaccactgcactccaccttgggctacagagtgagattctgtgtcaaaaaaaaacaaaaaca

SEQ ID NO: 55858 - DNA, 346 bp, Homo sapiens
catcccggttgattccagatagccgggggccttgaataccacccccggctatctggaaatcagttcctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaagg

SEQ ID NO: 55859 - DNA, 1492 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggtgggtaccaagatgcttttagaatcaagtatcggccaagcgtggtagctcacgcctgtaatcccagcaatttgggaggccgaggcaggcggatcacttgaggtcaggagttcaagaccagcctggccaacatggtgaaaccccgtctctcctaaaaatacaaaaattagccaggcgtggctgtgcgtgcctgtaatcccagctaccagggaggctgaggcaggagaattgcttggacctgggaggctgaggctgcagtgagctgagatggcgccactgcactccagcctgggtgacagagcaagaccctgtctcaaaaaaacaaacaaggctgcgcacggtggatcacgcttgtaatcccagcactttgggaggctgaggcggacagatcgcctgagctcaggagttcaagaccatcctggccaacatagtaaaaccctgtctctactaaaatacaaaaaattagctgggcatgttcgtgtgcgcctgtagtcccagctacttgggaggctgaggcatgagaattgcttgagcccgggaggtggaggttgcagtgagccaagatcgcaccactgcactccaccttgggctacagagtgagattctgtgtcaaaaaaaaacaaaaaca

SEQ ID NO: 55860 - DNA, 943 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaagg

SEQ ID NO: 55861 - DNA, 575 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgagaagtggcctgcatcgcagtgtacgaaacagacgtgtttgtcgtcggaaccgagagaggatgcgcttttgttaatgccaggacggattttcagaaagattttgcaaaatactgtaggtgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcagagtcca

SEQ ID NO: 55862 - DNA, 665 bp, Homo sapiens
gggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggtgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcagagtccagcggcggagtatcgcaaaccgtaatagacattacatccataaaattttcccagtccttattgta

SEQ ID NO: 55863 - DNA, 226 bp, Homo sapiens
agtattttcttctaagctatcataagcattctcctagaaacgatcctaacacatcttcttggattcagcttaccaaataaacactgcttaacactgcagagtccaagacaaatggtcattttattttatactaggtcctcagcggtactctggtttattagaataaatttcaaggacatagaacaaattatctttaattcctaaaataaacaccattttacaaaat

SEQ ID NO: 55864 - DNA, 2170 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55865 - DNA, 346 bp, Homo sapiens
atatcgtcgacccaggggtccgcccaggcgtccgcattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55866 - DNA, 2142 bp, Homo sapiens
  misc_feature (23)..(23): n is a, c, g, or t
  misc_feature (27)..(27): n is a, c, g, or t
aaggctaggtacgaggctggttnaatnggccgaggacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55867 - DNA, 2127 bp, Homo sapiens
gggctagtacgatgctgggtttgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55868 - DNA, 2334 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacaggtgagcagaggggcccaacccataaatcagaaggtgtctcaggcctgcctggtgcaaattttccaaggggtggtgcataagaggcccatttggcaccctggcttgtcggtggggagttggatgaccctactctgttgaccaactctcctctcctccactcccagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55869 - DNA, 2277 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55870 - DNA, 2083 bp, Homo sapiens
gttaactgctgatggccgccgtgccatcgtgtcgccctggcacgtagtgcctgtgaaacccctgtgtggtgcgcatgaatgccaggatggtgctctgtgctgctggctgcctgctggctgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55871 - DNA, 2263 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaagggttggtaagattaaaagaagtccctgtattgaggcacttagcgaagtctaaattgtaaaaaagatggcgctggtatctagctccacaaaagggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55872 - DNA, 1818 bp, Homo sapiens
  misc_feature (1818)..(1818): n is a, c, g, or t
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggacgacggggatcctctggaacgactatcacccagn

SEQ ID NO: 55873 - DNA, 2137 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55874 - DNA, 1261 bp, Homo sapiens
  misc_feature (27)..(27): n is a, c, g, or t
  misc_feature (30)..(30): n is a, c, g, or t
aactaggctaggtacgaggccgggtgntgnggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55875 - DNA, 1734 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagagaacgatttgggaggaaaacctcatgtccggacca

SEQ ID NO: 55876 - DNA, 1727 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacgcctggcagcagcacacccctccccccccagagagagcggcggggatccgt

SEQ ID NO: 55877 - DNA, 1645 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgaccgtggattgggcatagcccttactacaaagtgaa

SEQ ID NO: 55878 - DNA, 1874 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgaattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55879 - DNA, 905 bp, Homo sapiens
  misc_feature (49)..(49): n is a, c, g, or t
ctcattgggtggcgcatggcgtggctcgtggggtggctctttgggcggnggtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55880 - DNA, 1697 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgagggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55881 - DNA, 686 bp, Homo sapiens
ctaggtctatagtcgttccagaggatccccgtcgccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55882 - DNA, 822 bp, Homo sapiens
  misc_feature (13)..(13): n is a, c, g, or t
ctcgtgcaatctnggcagaggtcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55883 - DNA, 1850 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55884 - DNA, 1138 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaattcaaaaggccatcccaggcctggaaggttaactcaaggaggggccccccgggaaggaaaaacccggaaatttgggaaaccc

SEQ ID NO: 55885 - DNA, 1094 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55886 - DNA, 804 bp, Homo sapiens
acccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctactcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgaaaagtgcatcagt

SEQ ID NO: 55887 - DNA, 742 bp, Homo sapiens
gcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggtatccaggatgcagtgaga

SEQ ID NO: 55888 - DNA, 342 bp, Homo sapiens
cttccctcgctcatctcctctctttgctgtgccccaggccatgaggtttcctcccaaatcgtacaacaaggacttggagtctgcagagggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttccccctt

SEQ ID NO: 55889 - DNA, 436 bp, Homo sapiens
ttgaaaggggccacagtggctgagaaacgttggactatattactatttccaatcttctgatcgtctatgagaattccttcggtaagatttgttaagaattcagatcctgggctccttctcagacatactcggttgaaagccctgaggcaggacctaggaatctgcattctaatagtctcctgggctgtcttcatactcagcaggtttgaggccactgagtaaggggttcttgcagtcctctagtcccttgtcacagctctggaagcaggacgctccaggtttgggtggtgttcgggcccctttttcaggcagcccttcagaaattcgcagtgagtgtcctgcgtctcccctggcctgggaaggtctcctgccaagtcaattcctgcagcacagagggaaagggtgcccttgtctgattagaaacagacacagctgt

SEQ ID NO: 55890 - DNA, 378 bp, Homo sapiens
tggtaaagaaatcagcctaacccagccctgaactcatctgaccaccaaagcttttcctcacattggcaccctgagaaactggtattctgaagaacgcgctttaggaaaaactgctttagacaacaggaatttggtaagaagaactttgtttctgtgaacacatatttgcatgtcagggtacatccttttgtattttatttatatttagtgtgtctatgtcttgtcttcttggtagctttacaagaatttcgaggagagaaagtatgattttgtctctttgaattcctacttctcaccacccataatgtggtgcacacataaatatctgtaaatatgcagttagaactttgcatcactaatgagttaattaaactattc

SEQ ID NO: 55891 - DNA, 379 bp, Homo sapiens
ccgttctcagccctttatgcattgccttatgtagtcttcacaatagccctgtgaattggcactgttggaattaccatttacagctgaaaaaagtaaggcacagggaggttaagtcactcgcctgaaaccacccaatcagtctacctcaaaggcaagtgctcagcctgtgctctacagggaaattcacagaatcatccctgttttacaggtaagaaagcaggagttgataacggtgagaaattcctggccactcatgtgaaatgaataggaaaaaaaaacagtaaatatagggttcagtactacctacagtttcaggcatgcaatagaggtcttgcaattcatcccctgtggataagggacaactatttcattgcctgta

SEQ ID NO: 55892 - DNA, 351 bp, Homo sapiens
cctttgcctcaaattccctgaagcatctcttttcaaacatcagtcaagtgtgagccaagtccttggccttgccaatgtaaaggcaatttcgtcccttgggcaaaaattgccaaccttaatgggttccagctgttgcatggttgagtgccctctcagtcagcctacagcctgccctggcatttcaaagggctcctgccaggtctgtgtcacccccacgcaaaaggtgaagctggcctttgaaccacgtggccttgccctgtggatgtgcattacctccaagggaaaggaaatgacttccttctggctgcgtggcctggccagaggcctcaggagctcagattacctggatca

SEQ ID NO: 55893 - DNA, 1292 bp, Homo sapiens
gaaaagtataaacctaaggcatcacctttacagaaaatatcttccacggaaacatctaaaggccacagatcagccctggggttcagagggatcctgacagctactcctcaagatcctctctgttgtgattcatccccccggggccctacagtttctccttcctgactcttacatttctttggatggcatcattattttaggtgccaagcactgtggattctgcctctcagtgtccagacacccattttccttcccactgttccttccccatggagaagcctgtggctggctgacagcagagagagatgctcaacttggagaaggtgttacctgggccaggtggggaaggtttgtttgcagagcaaagaagtgaaggaagtattaaccctttgcatggcctcctgagaatccgacaagacgtaaatagccaagaatatctgtgaaacttcatcactgagttacaatatttatcactgcaagtgtgttgttcattgacactataaagccatgtggaattaagcagccttgaaacacaaaatggagaaaggctaagagctgagaattgttgccttcagggaaatacaatcaatgtcaagcaaacaaccaccccaaaatggttagctttatcagcattcaggcctacagtgaacgcaaatgttccagatctgagtttcaatttttaaagaataaacatatgcaaatgaccattagtcttagtagttttagggctcagaatgatcttatcttgttaacattcagggcaactgcttatacccatttgaatgtcatttagagggctaggaaagactgcttcaacatttgatgactaaatggcagggctcagccacaatgctcactccgagaaatgagaaatagacacaccagtatgctagatgctgatgcagttcaggaaatgctaccccaaaatatggcccctcagcatactgagtattttaagcagaagacaattaagaaaaccacaaaaacagaaaggtccctctgaccttctcccaccctctctctcttgaagatcctcatgtgacaggtgacctgccatataatcagaaggaagaaatgttacacagagaggctgagaagaatctgaggacttgctaagttttccccagtttattaccattagatcatatgccttttttgttcaatcatacttctatacaactgtccatcattcattaaacctaaccacaaaagtagttttcactcggtttttgagtgaaggctcctgtgtcacataaaacttacattaaataaatttgttccacttttaaaaa

SEQ ID NO: 55894 - DNA, 637 bp, Homo sapiens
gaaaagtataaacctaaggcatcacctttacagaaaatatcttccacggaaacatctaaaggccacagatcagccctggggttcagagggatcctgacagctactcctcaagatcctctctgttgtgattcatccccccggggccctacagtttctccttcctgactcttacatttctttggatggcatcattattttaggtgccaagcactgtggattctgcctctcagtgtccagacacccattttccttcccactgttccttccccatggagaagcctgtggctggctgacagcagagagagatgctcaacttggagaaggtgttacctgggccaggtggggaaggtttgtttgcagagcaaagaagtgaagatcctcatgtgacaggtgacctgccatataatcagaaggaagaaatgttacacagagaggctgagaagaatctgaggacttgctaagttttccccagtttattaccattagatcatatgccttttttgttcaatcatacttctatacaactgtccatcattcattaaacctaaccacaaaagtagttttcactcggtttttgagtgaaggctcctgtgtcacataaaacttacattaaataaatttgttccacttttaaaaa

SEQ ID NO: 55895 - DNA, 623 bp, Homo sapiens
atgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctgg

SEQ ID NO: 55896 - DNA, 858 bp, Homo sapiens
gtgagagaggatgaacattgtgtcctcatatggcagaagagtgaaagagagggaacacattcttgcaagccccttatatagtgacattcattcattcatgatggcagagctctcatgacctaagcaccttccaaaaagccccacctcccaacactgttgcactgggcatgaagtttccaacacatgcattttgggagacacattcagaccatagcatggcccaaataaataagtaaaaaacagcaacttagcgaaaacagattatgtagtcataagaaaacataggggaaagaacccaactatagttcatgttctttctgagcaaaggctatattgcatttctgaaaacaaaaacatgataccttttagaaaaggaatattataaaaacgtaaagagctctagtaatttaaaatgttataaatgaaaagttaataggagagttagaagattaaagttgaaggaatctcccaaaaagtagaacaaaaaaagccaaaagatagaaaggaagagacccaaataagaattgtgtcccctgaaaattcatgtgttgaagccgtaaagcccagtacctcaggacgtgactgtatttggagacagggcctttaaagagattaggttaaaatgaggccattagggtgagccttattgctatccaacttaggtccttattagaagagaaaattcggacatacaaagagacatgagggatgcaagggcatcctagaaagaccatgtgaggacacagaagaaagtagccatctgtaatacagggagagagaccttaggagaaaccaaacttactgataccttgatctcagaactgtgaaaataaatttctgttgtttaagccacaaaaa

SEQ ID NO: 55897 - DNA, 294 bp, Homo sapiens
tcttttatctgccccttccccaggctttggaggagaagatacggaccacggagacacaggtgcttgtggcatctgcacagaagaagctgctagaggaaagactaaagcttgtctcagaactgtgggatgctgggatcaaggtatgggaggcaagccccagggtggcagcaaacttaggtgtgctggacacaaactgaataaaagctcacccataatggatcctgccattacttctcaaaagtagagctaagaacagggtgccagcttggacaccctctgtccctgaggacagca

SEQ ID NO: 55898 - DNA, 757 bp, Homo sapiens
tcaaatgttacccggcatggatgcagcactttacagagctctctcactctaggactttaccttactccctcaaaaccctgggaaggagatggtaaaactaacccagttttcaggcctggatggttcagtgaccagtcaggaaagggaagacttagaacaaggacccgggactaaagtgctccccttttccatctgtctcacctggctgcaatagtccttccctgaggaaagcacctcattctggggacccaggagaggtaagagcacctgccaggcagcctctgcccctcagagccaaggaagtgacccagagctggctgtggtggggagcgtttgcactctgcagagaggagcagactggtaggggtgctttcaactcaaccttccctaactccctccctctacctgtgatgctgtaatgagccacttgctatatttctaccagggttgggtgtcctcactccaaacgaatgtctgagagttcttaggggaaatgctacctactcagcagttcttagggatgtgctgcctaattctgtgagaggcagcacatcatagtcaaaggaacatcgagttttagggtcagaaagatctaggtttgaatcttggcccttcccttgtgacgctgggttgcctcccagagcatccagccctgcacctctaaactgtggttaatattacttatccttgtcaggctgcaataaagatgaacgagtacagtgactagtacaaggcctggcacacacacacacaaaaa

SEQ ID NO: 55899 - DNA, 976 bp, Homo sapiens
aaataaacaacataataaacccaaataaagtagaatgaagggatttgagaaataaatattgaagaaaaataaaacaaaaaaatcaatttgagcttattaacaaaattcaaagctagttcttttaagatgtctaatactatagaaacatctttggcctgatatatgaaggagaagagagcaaaaggaaaaggacacagtaaatttaaaagtatgttttaatacaatacaatctatggcagaatgcgtaattgttcacaatactttgcatctccctgtattcatgtcctttgttatgtaaattcgcaattcctcctggtaatggtaaaatatatccacctccattcataatattgtgctggactgtgtgatttactttggcagaagtgccagtgccagttctgaatctaggccttaagggtatcacatatgtccacttatccctcttgtacttcttccatccccaggagaagaatgtgtctctggtagccaattgatccaaaaaggatctgacattttcagatgtggaaccaaggccagccaagcccagccaagcccagcatagatccgatccgccaaagcccaactgtcttacagatgtataaactggaataaatgttgctttatacttagtttggggtggtttactacacagcattattatggctatgctgactagcacactatgttaccaacacattggaaaaaacagaatatgcacataatttttctgaaaaatattttggcaaaatagtcccaagaagaagtagaaaatctgaacaaataaattaacacaaaagaaaaattaatgccaagttctgccaccaccaaatgacatgttctactatgtcttcaaaaagacagattattcttgtcttatataaactattacagaacaggaaaaatggtgagaaatgatccaattcatttttttaaaaaggtagcataacattggtagcaatgccagactagaacagaa

SEQ ID NO: 55900 - DNA, 498 bp, Homo sapiens
tctcaccctgtcacccaggctggagtgcagtggcacaatctctgctcactgcaagctccacctcccaggttcacaccattctcctgcctcagcctcctgagtagctgggattacaggcgcccaccaccacgcccagctaattttttgggtttttagtagagatggggtttcaccatgttagccaggatggtctcaatctcctgaccttgtgatccgcccagctcagcctcccaaagtgctgggattataggcttgagccaccgcgcccggcctaaacagttttcttaaaatactccagttctgttcatgaacttcgtcaaatacactgacacctgccaacttaaaaccgcaaaagaaaatcaattccatatattaaattgaaaatcacaaatcagattgcttaatgtaccaaattctctgtttaaataatgaacacgctcaaattatcttgatcattgcaaaacttaatcctaaatttaacataaaatattaacattc

SEQ ID NO: 55901 - DNA, 322 bp, Homo sapiens
taataaatagtatatgtagtgaagaaaaagttataacaagtatacattacatttaacacacctagcacataggacaccctcaacaaacagctacagctgctgtaaatcatgtgtatataatataacatgcaagcatatcttcatgtattgattaattactacttcttggaaaaggatctgaggaacatatttaatatatttaatatgcctgctcatatgttcatttagtgcttatcaattatatttagtgcttttctattagcttcatccatttgattaagatagcaacttgtattatttaatatatgttactctgtgctgt

SEQ ID NO: 55902 - DNA, 278 bp, Homo sapiens
cagttatttatacataaagctaaagaaagtcttcccaggtgaagcctttaaagtaatactacatgtgcttcccgatgtttataatgcctgctgcacagaaatcccactttaggtcactagccatcacatgggtaacatgagaaagataatgaaaatattcttgaagtttcctgaagtgcaacaactgggaaatctcttagcaaccaacatgtaaaaatatacctgtacactcttttctattcattttatcttgaacggagcagtaagaaaaccacgtg

SEQ ID NO: 55903 - DNA, 231 bp, Homo sapiens
ggaaatgagcacagagagaaccagtcacagcatgatggaagaaacctggaactaaagcctcactacttctctttcctgactgccccgccacctcagatcccaaatccacagcttacaggaagtttttaccaatgttatttctaagtgagcacagaatgtacggtccaagccagtgataagaattctccctgtagcctggggttattgtaattaaagtgcataacttatctc

SEQ ID NO: 55904 - DNA, 369 bp, Homo sapiens
tgccattagcaacactgttcagatgagataattaagaaaaaaagccaattgaatgattgagtgaatgaatgattgaaaatctttccgaagttataataataattgtgattattggggtcaaagcaaaaccattttagtctaaaagattgtacactataccaacttttacccaatttggaatgaaaaattacatttccaaaccatgtagaaattctgaactctttgaaatattttcttttgtgggaaagaaccagaaattctttgtcatatgtacccatttatcttattttagttacccaaccaaaagataaaataatattctcaaagagataattgactggaggagtttaaagtgtttataaatattag

SEQ ID NO: 55905 - DNA, 2513 bp, Homo sapiens
catcactagcttgcctccaagctctctcactatgaacagacaagtttgcaagaaatccttcagtggcaggagccagggtttctctggccgctctgctgtggtctccggcagcagcaggatgagctgtgtggcccgctctgggggagctggtggaggggcctgtggcttcaggagcggagcaggcagctttggcagtcgcagcctctacaacctgggcagcaacaagagcatctccatcagcgtggcagctggcagctcccgggctggaggctttgggggagggcggagcagctgtggctttgcaggtggctatggaggtggctttgggggcagctatggtggtggctttggtggtggcagaggagtaggtagtggttttggaggggctggtggctttggtggagctggtggctttggtggtcctggtgtatttggtgggcctggcagctttggtggtcctggtggctttggccctgggggctttcctgggggaattcaggaagtgattgtaaaccagagtctcctgcagcccctcaatgtggagatcgacccccagattgggcaagtaaaggcccaggagcgggaacagatcaagaccctcaacaacaagtttgcctccttcatcgacaaggtgcggttcctggaacagcagaacaaggtcctggagaccaagtgggaactgctccagcagcagaccacaggctcagggcccagcagcctggagccttgttttgaatcctacatcagcttcctatgcaagcagctagattcacttctaggggagagggggaacctggagggagagctgaaaagcatgcaggacctggtggaagacttcaaaaagaagtatgaagatgaaatcaacaaacgcactgccgcagagaatgagtttgtggggctcaagaaggatgtggatgcggctttcatgaacaaggtggagctgcaggccaaagtggacagcctgacagatgaagtcagcttcctgaggaccctctatgagatggagctgtcccagatgcaaagccatgccagtgacacgtctgtggttctgtccatggacaacaaccgctgcctggacctgggcagcatcattgccgaggtccgcacccagtatgaggagattgcccagaggagcaagtctgaagctgaggccctgtaccagaccaagcttggggagctgcagaccacagctggcaggcatggggatgacctgaggaacaccaagagtgagatcatggagctcaacaggatgatccagaggctacgggctgagattgaaaatgtcaagaagcagaatgccaacctgcagacggcaattgcagaggctgagcagcgtggagagatggccctcaaggacgccaatgccaagctccaagacttgcagactgccctacagaaggctaaggatgacctggctcggctcctgcgtgactaccaggagctgatgaatgtcaagctggccctggatgtggagattgccacctaccgcaagctgctggagggagaggagtgcaggatgtctggagaatgtcagagtgccgtgtgcatttcagtggtcagcaatgtcaccagcacaagtggcagctctggcagtagccgtggagtttttggaggggtcagtggcagtggcagtggtggctacaaaggcggcagcagcagcagcagcagcagcggctatggagtcagtggcggcagcggcagtggctatggaggggtcagcagtggcagcactgggggcaggggtagcagcgggagctaccagagcagcagtagtgggagcaggctcggcggtgcaggtagcatctccgtgagccacagtggaatgggctccagctctggcagcatccagacttctggaggaagtggctacaagtctggtggtggaggcagcaccagtatccgcttctcccagaccacgagctcaagccagcatagctccaccaagtgatctactgttccaaatctctataaccacctgcttcccactcagcctgcaatagtgtttcccactctctgcttggcatcaatagatgcataagggtcaaccacatttttcctcaagttccctggagaagaagctgaactcctggtttctccatccccatgaccttcccagggccatggaggtcctgctgctggtctgggatgatgatgcccctggaaaccttcctgcaatggccccttactttggacagcaacccctgagcccaagccagttttggccttcacagcctggccggttcccactctggcccatctcccattcttactgggagttggagatttgaagccagtcatctcagcactgtctgaggagggcagagccatgggttctgtgctggagggtgcacggccaagatctccagactgctggttcccagggaaccctccctacatctgggcttcagatcctgactcccttctgtcccctaattccctgagctgtagatcctctggtgatgagtatgttgcactttcttttctcaataaattgcactgaacttcaaaaaaaa

SEQ ID NO: 55906 - DNA, 2213 bp, Homo sapiens
cggccaggctggtacaggcggctgctcgcggaggcacttctccgagcgtgacgtgcggactccgctccactgcggcccgcccgcccgccggtctagccgccgcctccttcgctccctgagcgcgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcagcgagactggctgggaggagggcccagggccactgacggccacagaggacagtgccccaaaggagagcctcgggttgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttatttta

SEQ ID NO: 55907 - DNA, 2314 bp, Homo sapiens
  misc_feature (2227)..(2227): n is a, c, g, or t
cggccaggctggtacaggcggctgctcgcggaggcacttctccgagcgtgacgtgcggactccgctccactgcggcccgcccgcccgccggtctagccgccgcctccttcgctccctgagcgcgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcagcgagactggctgggaggagggcccagggccactgacggccacagaggacagtgccccaaaggagagcctcgggttgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttattttaaaaaaaaaaagggnggggtcaaagtatctcgaggggccaaatagcgtacaagtttgtaaaaggggccatgggggttaaaagagaggcggtaaacgggaacc

SEQ ID NO: 55908 - DNA, 1975 bp, Homo sapiens
cggccaggctggtacaggcggctgctcgcggaggcacttctccgagcgtgacgtgcggactccgctccactgcggcccgcccgcccgccggtctagccgccgcctccttcgctccctgagcgcgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcagcgagactggctgggaggagggcccagggccactgacggccacagaggacagtgccccaaaggagagcctcgggttgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttatttta

SEQ ID NO: 55909 - DNA, 1722 bp, Homo sapiens
cggccaggctggtacaggcggctgctcgcggaggcacttctccgagcgtgacgtgcggactccgctccactgcggcccgcccgcccgccggtctagccgccgcctccttcgctccctgagcgcgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcagcgagactggctgggaggagggcccagggccactgacggccacagaggacagtgccccaaaggagagcctcgggttgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttatttta

SEQ ID NO: 55910 - DNA, 570 bp, Homo sapiens
tgttctccactaggccgggcgtggtggctcacgcctgtaatcccagtactttgggaggccaaggcgagtggatcatgaggtcaggagatggagaccatcccagctaacttggtgaaaccttgtctctattaaaaatacaaaaaattagcgggcttggtggcatgcaactggtcgcccagcgtgggcgacagagcaagactctgtctcaaaaaaacaaaaaccttaatacggctgggcatggtggctcacacctgtaatcccagcactttgggacgctgaggtgggtggatcacctgaggtcaggagttcaaaaccagccttaccaatatggtgaaaccctgtactggagactgtcataaagatctcagtgtttgttaggaaatatttggtgggtgtagatgctcttaagacccatgtgtcttcattttagaactttaatttgattccctttcctaggttcatattgagatccattgaaggccctcccagactgacgaaggcgtgacctcaggcccaccgcatccaagaacacgaagcatgagggacagaagagggcccctcggcacctgc

SEQ ID NO: 55911 - DNA, 236 bp, Homo sapiens
ggaaaaaattgaaactcaagccaaggaaactaagaaatttagtaaaatgatacaagagctcaaacagaaaataactattatatgcaaaaaccaaactgattttctacagctgaaattttcactacaacaatttcataatacaattggaagtatttacagcagaatagaccaagctgcaggaagaatctcagagttcaaagaccagttctttgaatctcagtcagacaaaaataaag

SEQ ID NO: 55912 - DNA, 257 bp, Homo sapiens
ctgctaatgttcaagatatatattagttttctatttctgctgtaacaaatactacaaactcagtggctaaattaacaaatttgtcttgcagttctagagattagaagttcaaaatgggtctccctaagcagacatcaaggtgtcagtagggctatgttccttctggaggctctaagagaaaacttgttttcttgctttttacagcttctagagaatgtccacatttcttgactcatggccaccttccaacttcaaag

SEQ ID NO: 55913 - DNA, 393 bp, Homo sapiens
ggacaacatcttctagaaaaagcagccattcagtaaagattttgggtgcgtagatgatttgatgggctagagaattattcctgaaagttccttgcttgcattattaaccaaattatcaagcctttcttaaaccggttatacttttctggccataccattttccaggtcacaagaagcatattcatgggtacaaccccacatggaaaaggattaatgtagctagacggcccaagttgaaatcaaggccctccgaactttttaaaaagttcatccttgcccatcatcagttataaaataagtacattcctacaagtatcccttcagaggtccattacaaaccggaaagaatgattgcaatgcaggtgccgttcgttattcagctgtccattagct

SEQ ID NO: 55914 - DNA, 698 bp, Homo sapiens
ctagagcccaggtgtcctggctcccacactaccttgcagcccgcccacagggaggaaacgcaccacacaactccactggcagcaaagagaagctgataaaccggttatcactgatttatctccgataacctgggagatttaagccacttctgccaaatcagggtatgatttcttaaaactctgtgagcaaatgcctgctcctggggtgctggagtttggctggtggtaaggccttcacccactaaaccgtgagaacatgattcccaagagcagagtacaaaacagcatcaaaaccaggcgcggtggcaggtacctgtagtgccagctacttgggaggctgaagcgggaggatcacttaaacccaggagtttgaggttatcgtgagctatgactgtaccactgcactccagcctgggcaacatagtaagactgtatctcaaaaaaaaagaaacagaatcaagtgccaattgtgcgcagcccaggtttgcgccctgggattcagagcaggactcacaagtcgtgtgacgaggtggtattgcatgctgtgtgccaggttttagttccttcactccctgacatgcctgctgtgtgccctgtgccatgtgccaggccccatgctggtctgagtagggtgaaccagccaggcacagggtgacgggctgggagcaggactctcgtctccctccactctggggccc

SEQ ID NO: 55915 - DNA, 366 bp, Homo sapiens
gtttggctaatcatcctatgattttgctatagcttgaaaactttttatatcttaaatttttttataattttgaagtattattgtttgggctttgtatatccagtgtattttcaattaaattcccctaactaaagtaattcaaaaggaataaaagtgtaatgtgggctgggcgtggcggctcatgcctgtaatcccagcactttgggaggcccaggcgggcagatcacctgagggcaggagttggagaccagcctggccaacatggtgaaaccctgtctctactaaaaatacaaaattagccgggtgtggtggcacatgcctataatcccagctatttgggaggctgagtcagggagaatctcttga

SEQ ID NO: 55916 - DNA, 330 bp, Homo sapiens
agaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatga

SEQ ID NO: 55917 - DNA, 950 bp, Homo sapiens
tagatttgcaagttttgtagctttttatctgtattaacagaaagggcaaatggacaccattgtctgttttctaattcaacccatcaatcagtctactatattggaaaatgaatagctctccttataaaacagtctcctaaagaatatctgaggccacgcatagtggctcatgcctataatcctaggcctttggggggtcaaagtgaaaggattgcttgagcttaggaattcaagaccagcctggacaacataatgagacccccatctctacagaaaaattaaaaaattagccaggcggggtgttgcatgtttgtagtcccagttactcaggaggctgaggtgggaggattgcttgaacttgagaggttgagactgcagtgggctatgattgggacactacactccagcctgggtgacagagttgagaccctgtctcaaaaaaaagaataattgacttctctagtacgtgtatatcaggccttggcttttgcctttgtgtactaaaaggtccagtctagttttagtttttgaacttggacaagaaattttttgtgaagcttttgtttcacaaatcagtaagtgctagaattagtccatatacagtcatgtgcctcataatgacatttcagaccacttatactaggttggttccataagattataatggagctgacaaattcctattgcctagtgacattagagctgtagggcaatgcattactcaagtgttcatggtggtgctgttataaacctactgactgccagttgtataaaagcataacatatacaattacatacagtacatatgtggcaggccattcttctattgctgtaaagaaatacctgagactgagtaatttataaagaaagagctttaattggctcatggttctgcaggctgcacaggaggcatagcggcatctgcttctgagaaggcctcaagaagcttc

SEQ ID NO: 55918 - DNA, 303 bp, Homo sapiens
agtctttgaagatataattaagtaaaggacctcaagataagatgatcttggattatccaggtgggccctaatccatcgacaagcgttcttataagagatagagaggagaggacacaggaaccgatgagaaggccatgtgagacagaggcagagactggagtgatgcagccacaagccaaggagccgttgaaatcccagaagctgaaagaggtaaaaaaagggtctcccctggagccttcagagggagtgtggccttgctgacaccttgattttggccttctggcttccagaactgagaatggc

SEQ ID NO: 55919 - DNA, 429 bp, Homo sapiens
ccacaccttcagcgtgggcatcatggccatcatgaacatgtcacactgctgcagagattttgtttatggccagttttggggccagtttatggccagatttgggggcctgtttccaacactgccctgctatacctcctcctcctccacattcttatacaagttatctgagatacaatctgggatttttctgactgaagcatataatttaaccatattctcttgaccagaacagattatttcttgaatcaaactaataagatcaattgactaattatatgtggaataagttgctgaaatgtgaatctcagatgtgcattagaggacaagtcttaatgctgcagcaatatgcattctttttttttttttttgagatggagtttcactctgtcacctaggctagagtgcagtgatccagtcttgcctcactgc

SEQ ID NO: 55920 - DNA, 345 bp, Homo sapiens
ctccaataagaccctggacggcgcgggtacggggttgcaagaggtcttggtgactccttgagaaagccgtctgggggactggattagaaaagtcagcaggttaatgccaataggatttcccttttaaatgtcacctgccacagtggctcaagtcctgggggatctgataattaaagatggccttgtgcttccttaaatagaaagcttggcacacaaatgacttcaagagtcaaatccgcgttgactttacgcacctctccctgcagcctgagactctcggctgagcttggctttgtgtggccttgcgcctcctgccccctagtgggcgtgatgctcacagagcta

SEQ ID NO: 55921 - DNA, 376 bp, Homo sapiens
caccatgttggccaggctggtctccaactcctgacctaaggtgagcctccaagggcctctttgaataaccaggaaatcaagccctaaatgttggtttcatccacaaggacagacgcagacaggctttgtattcacggaagcagtgagcggtgcgcacgggagccatcagggtcgcctctggggtcaacaccaaacctctctctctgcctttccttcccttgtgcgtggtaaggtgctgaggaagtcaaggaaatcggaacagcagggccacttccagctgcgcagattggatgtgcacagacgttcatcattcaatgtcctaaacatctaaatagttttaaagatgttactaattaaaaccatttttcaaaaatta

SEQ ID NO: 55922 - DNA, 233 bp, Homo sapiens
aggaaaggaaaatgccccctagtggattacgttttaaccactgtgctaacttgagagatagcctgctatctctttacgggacatgagggatgataagcacctcattgcatggtcctggggactgatgaacaaaggctaacatgtggaaaagagcaactaaagaaagaagagccacctccaggttaattagtagaagtctcctcgctgatatgctctcatacactaaaacagca

SEQ ID NO: 55923 - DNA, 359 bp, Homo sapiens
agttttccactgtagtttggataggttcagtactctaaaataaaaccagtcactgcagatagatttccattgcagaagattcttccataaagaagtgatctgtagaacacttgcttctttatcccaccatatagtcttattagttgtggtaagtagctctcatctgttgttttcatgaaaatgaattctataacaaatactatggtctctgtaattgctctgccctataacagtgctattcattgtatgcaatttatattataaactgaggaagaaagtaggaaagttgtaaacataggcttctagagtaaaccagctagcaacgattgctttaaaagacacaaaaaatgtatacagta

SEQ ID NO: 55924 - DNA, 239 bp, Homo sapiens
atactcagaaaagtcagtgatagcaaagcagaaaccttatactatgatgcaatttgaatagtaaactagttttaaatcatgcaaaattgagacaggaatacatgatatgatgagaaacacattggtaaacaatcagataaaacagttaatggaatgccatgttcaagctaggcaagaaagaattaacaatgcatcacttcttttctggtgaattctaacaaggtttatttccactcagc

SEQ ID NO: 55925 - DNA, 394 bp, Homo sapiens
gaaagcaaaatgaatgcagggaaatcaggaggggattattgcaatagtcaggggagaaatgaaggtggcttggagtaacatagaggctatggaaataaagagagggagaggcagattcaggaactgtctttgatgtgggattgacaggatttcgtgcctgaatagatgtgtgcgcaaagagaacagagcacctcagatcatttcccgtttccggcctagcaacctgtggatggctgtatagaaaaggagatctgcttgggacgtttgaagtgcctttgagacatccaagtggcaatgaaaagcaagagttgggtttacagagccagagcttaagcaagagagttacctccagccatgggagtaaaggcagccacccaccaggcagagagactgg

SEQ ID NO: 55926 - DNA, 511 bp, Homo sapiens
gccgacaggaaggtgaagaagtcatctgcgtgctgtgagggtggcgcaccccaactccatggggacagaaggtcctgcatttaggacccttccagacctcacacctatgtatctcttcatctggctgattacttatatcctttcaaagacgcttcttagtaaactgtgcctccctcacatggccagcggagaagggccttgccctacctctcagactgcagccctgagccactccttggaggtgaggagcaccattcacctgagcagctccccgccctggtgtctgagaaataaatctgccttcagtcatacggttctaccaatctgagcacacgacctcccgatagggtactgaggatggcttctgacctggaggcatcaaggacctgaaggcagtaaccatttcagaggacagccacatccctcaaattacaaacatctaaaatgtccattaactgttgagtggatatataaattctgatgttttataaaatggcataccctacatcaa

SEQ ID NO: 55927 - DNA, 555 bp, Homo sapiens
acaatacctgtaccacctttgtatcttggagctgaataacttctttttgattttacaggctcataggtggaagaaacttaccttgagtctcaaatgagactttggacttttgagttaatgctggaacgagttgaccttgggggactattgggaagagatgattatattttgcagtgagatttaggtggccaggggcagaatgataatagtttttatgtttgtctcctccaaatcccgtgttgagatgtaatccccaatgttggagatagggcttggtgggaggtgtttgggtcatgggggcagatctctcatgaatgccttcgtgccctccctgcagtaatgagttcatgtgagatctggttgcttaaaagaggctggcatctctgcctctctgtcttgctgtttttcttgacgtgtgacatgttggcttccctttgccttgcaccatgattttaagcttcttgaggctctcaccaaagcagatgctggcactgtgctttgtgtgcagcctgcagaactgggagccaaataaacctcttttgtttggaaattacc

SEQ ID NO: 55928 - DNA, 111 bp, Homo sapiens
attcctccacttactcaagccagaagccttggaagcatcttattcctcccacgctccacaccattccttcagattcctccggcagctctaactttgcccagattctaccac

SEQ ID NO: 55929 - DNA, 835 bp, Homo sapiens
ccttgtacaatacagcacctaacacagcgccctaaaagagtaggtattcaataaacagtcattgaatgaaagaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatacagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaagtttgatgccttacattttaaaaggaaaagataaatggttgattaagaatc

SEQ ID NO: 55930 - DNA, 2527 bp, Homo sapiens
tgaagatgctgaagatgtaccagtcttcaaagaaagctaaagaaggcactgaagatgcgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacaatagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggatgccactaactacggttctttaggaccaagatataaaacagtcactaaaaatcattaggctaggtatcagtaatacattcattactaataatgcatttttggagactttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatacagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaagtttgatgccttacattttaaaaggaaaagataaatggttgattaagaatc

SEQ ID NO: 55931 - DNA, 1739 bp, Homo sapiens
  misc_feature (1645)..(1645): n is a, c, g, or t
  misc_feature (1667)..(1667): n is a, c, g, or t
  misc_feature (1678)..(1678): n is a, c, g, or t
  misc_feature (1720)..(1720): n is a, c, g, or t
tgaagatgctgaagatgtaccagtcttcaaagaaagctaaagaaggcactgaagatgcgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacaatagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggatgccactaactacggttctttaggaccaagatataaaacagtcactaaaaatcattaggctaggtatcagtaatacattcattactaataatgcatttttggagactttgtgagagtggncaaggtgaccctgggcagcaanccccaaccaanggccagaggcagccccctttttctgggggggtcaccccggangatttttggggggccccag

SEQ ID NO: 55932 - DNA, 340 bp, Homo sapiens
gcacgagaaaataatcatttgtaaaattcataattttctgcataaactatatttaaatgccatattaaaaaggtgacaaattcaggtaagattatcgagagtaagaattgaataccacttttatcctgatattcctatcttataacctcccatacaacagatgcaaaatatattttatgtatgttttgttttatttatgatttaccaaatctcattttacagattatttgaggtgagcctacacacgtgtgtgtgtgtgtgtgtgtgtgtgtgtgtgtgtgtctcttacatagcacatacaatacagacagttttgactttaaaaaaaatagaggatagt

SEQ ID NO: 55933 - DNA, 320 bp, Homo sapiens
gtgtgaataggcaagcactttgtttgttgtactaaggaactcaaaatgataggctttttgtcaccatgtgcttccaggatctctgttgcatgagcagagatagaggatcttgcacaaacaattaaatgctctagccataagtagtgcaagtttcctttgcttgaaatttactgctgatagccacttggtcacaccttacttccagaggctaggaagtacagttttcccacagtctaagaatgaaagagaattaaccacagtaatgcatagcactcataccatggatgactggataattttaaaagaatgaaatatgcaag

SEQ ID NO: 55934 - DNA, 453 bp, Homo sapiens
cagatcaccaatggcggcatatttttatccatcccccaccccctttttttttctaagagatagggtcctattctgtctcccaggctggagttcagttgtgcaattgtagctcactgcagcctcagacttttgggctcaaccaatcttcctgcggcagcctcccaagaagctaggactacagtcacatgccaccatgcccagctaatatttgtattttcgtttgtagcaacagggtgtccctatgttgcccaggctcgtctagaactcctggcctcaagcaatcctcccactttggcctccctaatatatgggattacaggcatgagctactgcttctggccttatttacatctttactttggagtttgtctttctcttctgtgggctattacatgaactgtcttagcccattctataaaacattttctgccttggtcacgtggaacattacga

SEQ ID NO: 55935 - DNA, 657 bp, Homo sapiens
cttctctccttctttgaaaagcctttttttcttattcttagaacctttgttagtactatataccaaagccagggcataaaatttaccttttttcttaggttaataacaacttgggtggaatcttatatacagactgagacactatagataactccctttgaaagctatgactgaaattaataatagaattgaactaaaaactggcagaaaactatctatttaatcaagtattagtctaaacaatgtaagacatgataagggagaaggggtgatagctgcattaaaagaaatcctaggaaatcattttgagagagacctgatgaatgtttatatggttcatgctcaactatcagcaattttaataataagatcagagttggccaggcgtggtggctcacacctgtaatcccagccgtttgggaggccgaggtgggcagatcacaaggtcaggagttcgagaccagcctggccaaagtgaaaccccgtcttaactaaaaatacaaaaaaattagccaggcgtggtggcaggcgcctgtaatcccagctgcttgggagactgaggcacggagaattgtttgaacctgggaggcagtgcttgcagtgagcccagattgcgcctctgcactccagccagggtaacagtgcaagactccatct

SEQ ID NO: 55936 - DNA, 292 bp, Homo sapiens
ggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaa

SEQ ID NO: 55937 - DNA, 3607 bp, Homo sapiens
ctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgaggtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaag

SEQ ID NO: 55938 - DNA, 6621 bp, Homo sapiens
aagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacgtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgaggggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacaca

SEQ ID NO: 55939 - DNA, 7112 bp, Homo sapiens
aagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacgtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgaggggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaaactttggtttattcatcatctcaggttaacagccacgaaaatcatcttttcattatataattctgcttcttagaattttccttatgaaatgaaattcagacagatttatttaaaatatttatttatatgtagatttagaatgacagcatcaagagttcgcaacatcctagatgcctgacagtaaaatactggaggaaacagcccatgtcgatgacatggaaaatgttcaaaatataatgaaggaatgacagaaaattatgtataccttaagatacctaccaagcaaacaaaattttacatgtaagtatagaggaacctaggcgtcatttctaataagcgggattaaaaagtactttgactttttcccattttcctaatttcagtctccatggatttgcctattctggacatttcatataaatggaaacatatagtatgtgaacttttctatctcacttcttggcaccaaagcatgttgttattttggctg

SEQ ID NO: 55940 - DNA, 6564 bp, Homo sapiens
aagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacgtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgaggggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatcagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacaca

SEQ ID NO: 55941 - DNA, 4342 bp, Homo sapiens
aagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacgtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggtctggtagggctgagcttgcaagaggatcaacatgcctttggctagagatttactacatccgtccttggaagagg

SEQ ID NO: 55942 - DNA, 292 bp, Homo sapiens
acagtttaattatttagggttgttaggtcattatttttacccttttaaacttacaggtttttctggcaaaaagtgagagagtaatttattatattcttaatcctatttcatgtgcttatttttttcatcagtaggttcattcctgggcttcacagacgtacacatcagagacatggaatactgtgccacacttgatgggtttgctgttgtatttaatgatggtaaagttggatttattacaccagtgtcaagtagatttactgcagaggtatgacttatttactttgaaggg

SEQ ID NO: 55943 - DNA, 472 bp, Homo sapiens
agtcaggcaaacctcccttttttttcttccttttctgctgatcttcaacaatttacttaactcagtttcctcacttgtaaaatacaaatgatatgcctatctgcagagtcactgggagaaataaatgaaatgacttaaagtatatgtatgctatctggcatgtagtaggagtttaataaattatagtttacatacaccagaagagtacttgcctcgcttttccttgtatggtactttttaatcttattattaaactaacccctgtggtggtgtggctacattctttgagtttagaaaacgagataaagaattgctcatatcttcccaaattgtgtagtataaaaagaatgctgtcctggttgttttttgtagaatatggaagtccctgcagtaagtaggcaacatgctacccttctattcaacacagcactagaacaaggcaagtgggacctttgtcgacacatgattcgat

SEQ ID NO: 55944 - DNA, 839 bp, Homo sapiens
ctccccactcttgtattaactgaagaaaatccatgacatattatctataaatatttcagtttttttcctacaaggactctttaagaattatgaccaaaataccattatcatccctataaaaatttgataattccttggtaccatcaaatatccattaagtattcagatttctaattgtttcatagacatcataattttgtataggttaagatttaaataaggttcacatattgtgattgtgttcttaattctctttttaagtggatgttcccccaccctctccttttcccttccttgcagtttattcatggaagaaatttggttttgtggattttctcacaataatgattttgcttattacatctccatggtttagtttaacagtttcctctatttcctgtagtagctgaatgtaaagacttggtcaaactctagctagattttattgagggagttggggaagactgcttcataggtggtggtagtatatttttccatctaaaggtacataatgtcggttatctaattctttctttaaatgttttctatgttcacatggtaattttagccatggatttcatgttttagtttcaagatcctgagaaatcaacatctgaggaacagctaatatttaaaattaaaggaaaatatattttctccacgaagttggttgtaacttttggcaattcttcatcaggtgatgaatgcagtattggttcagccacagacttgactgaaagtagctccatggtggatggcgactggacaatggtggatgaaaatttctctacactcagtttaactcagtcagagctggagcacatttccatggagttggc

SEQ ID NO: 55945 - DNA, 374 bp, Homo sapiens
  misc_feature (6)..(6): n is a, c, g, or t
tgtgtntatcgatgcacccaattatgtggattcacataattgagtggcaagatagtataggactcctttccgattcctaaaaccattagtatctactaatttgacgctgaaattttgtatttttggtggagacaaggtttcaccatgttggccaggctggtctgacgctcctgacttcaagtgatccggcctcccaaagtgctgggattacacgcgtgaggccagaaattttaactctaaaacggtatcacttcccatctggaattctgggcactgaggggatggtgatagaaatggcttatcttttaaaggtttagattctggatcctccacttactattctgtggcatcgataaacacgggtaccgagctcg

SEQ ID NO: 55946 - DNA, 414 bp, Homo sapiens
gtgagctaccgtgcccggcttgaggtgtttttttaactaatacattgtagcactattgctggtatgtggattcacataattgagtggcaagatagtataggactcctttccgattcctaaaaccattagtatctactaatttgacgctgaaattttgtatttttggtggagacaaggtttcaccatgttggccaggctggtctgacgctcctgacttcaagtgatccggcctcccaaagtgctgggattacacgcgtgaggccagaaattttaactctaaaacggtatcacttcccatctggaattctgggcactgaggggatggtgatagaaatggcttatcttttaaaggtttagattctggatcctccacttactattctgtggcatcgataaacacgggtaccgagctcg

SEQ ID NO: 55947 - DNA, 256 bp, Homo sapiens
tatttttggtggagacaaggtttcaccatgttggccaggctggtctgacgctcctgacttcaagtgatccggcctcccaaagtgctgggattacacgcgtgaggccagaaattttaactctaaaacggtatcacttcccatctggaattctgggcactgaggggatggtgatagaaatggcttatcttttaaaggtttagattctggatcctccacttactattctgtggctcagtttcattagattaaaaaaaaa

SEQ ID NO: 55948 - DNA, 96 bp, Homo sapiens
gcataaggagctttgacaaggacccactgtctggccccatcttcagagattccaataggtctggggtgtgcacaggcactggcgtctttaaaatct

SEQ ID NO: 55949 - DNA, 362 bp, Homo sapiens
gaagtcacatgccaacatctgacaagtgccctttacgatgtagcctcaagtatgtaagcggcaagaaccacagcctttagagcgattttggaattaagttgttaaaatgtgtttttaacttagtacttactgaaatatccattctcccgcagacagacttatagctgtcttccactagggctggaaattgaccttttaaccactgacagttgacaggatgtttattttcccattataacagttgccaattgtccaccaatttctcttctcacagaaataaagaaggtcggctgtgatgaactatactctctgtagcctctctctgacaatttctttatacctatatttgatattggtagttc

SEQ ID NO: 55950 - DNA, 574 bp, Homo sapiens
cctctcaggtttcagtgatgaataggcatgggaaagtaggaataccaaatggcctctcatttggtagtcggttggggaatgcatgagagaaaataagaccacagtgtgcccagggatgctgagctgatggcacattttgagcagtaaactttcttagtgtagatccctccttcctcgctccctcttttccttcattgttcttgtcctaatttacaacttcactaagttcttcctttcccacttgtatactttgtaggcaatatatgttttggtttgtgaactacctcacattgtccccaagggcagggaactatgtccttatgtcccttttccccaggagggctgaataaatgcctgttgattaactcaacttggtgtaacaaacatatattatctataatgcataagtctctgagctaagggctctgacatgtacatacggaataagaaataagattcctgccttcaagaaacttccaggagagagaaaagagctcctcaagttattataatacatagtaaatgtgatgagaactaaaagacaaaaaaaaaacaaaccacttttaatgcaaag

SEQ ID NO: 55951 - DNA, 735 bp, Homo sapiens
  misc_feature (485)..(485): n is a, c, g, or t
  misc_feature (508)..(508): n is a, c, g, or t
  misc_feature (735)..(735): n is a, c, g, or t
ggcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaacaagggaggcaagcacaagactgggccaaaatctccatggtctctttggggcggaagacaggtcaggcccctggatactcttacacagccgccaaataagaaccaaagggcattcatcctggggagagggatacactggatggagtatttgggagaattccccaagaaggtacaattcccctggaaaccaaaaaatgatctttgtcggcattaagaagaaggaagaaagggcagacttaataggcttatctcaaaaaagctactaatgagtaataattggccactngccttatttattacaaaacaganaatgtctcatgacttttttatgtgtaccatcctttaatagatctcatacaccagaattcagatcatgaatgactgacagaatattgtggggcagtcctgattgaaactaagactggcttgtggttgaatgaatatgttcagttttgaagttgaatagtaaactccagttcagctaaatggtatcactgttgacccttttatgatatgattagacttcgttagtactn

SEQ ID NO: 55952 - DNA, 890 bp, Homo sapiens
  misc_feature (640)..(640): n is a, c, g, or t
  misc_feature (663)..(663): n is a, c, g, or t
  misc_feature (890)..(890): n is a, c, g, or t
ggcggagcgagtttggttgcacttacaccggtacttaagcgcggaccggcgtgtccttggacttagagagtggggacgtccggcttcggagcgggagtgttcgttgtgccagcgactaaaaagagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaacaagggaggcaagcacaagactgggccaaaatctccatggtctctttggggcggaagacaggtcaggcccctggatactcttacacagccgccaaataagaaccaaagggcattcatcctggggagagggatacactggatggagtatttgggagaattccccaagaaggtacaattcccctggaaaccaaaaaatgatctttgtcggcattaagaagaaggaagaaagggcagacttaataggcttatctcaaaaaagctactaatgagtaataattggccactngccttatttattacaaaacaganaatgtctcatgacttttttatgtgtaccatcctttaatagatctcatacaccagaattcagatcatgaatgactgacagaatattgtggggcagtcctgattgaaactaagactggcttgtggttgaatgaatatgttcagttttgaagttgaatagtaaactccagttcagctaaatggtatcactgttgacccttttatgatatgattagacttcgttagtactn

SEQ ID NO: 55953 - DNA, 367 bp, Homo sapiens
cacgccgtacaccctaacatgctcgccagcatgcgcgcgcaggtccttggcgcaggcattgggactggagccaatgaggtgcggcgacgttactgcgtagccgccagctcggccgcacgtcagggcgcgggaggcggagcgagtttggttgcacttacaccggtacttaagcgcggaccggcgtgtccttggacttagagagtggggacgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctg

SEQ ID NO: 55954 - DNA, 861 bp, Homo sapiens
  misc_feature (611)..(611): n is a, c, g, or t
  misc_feature (634)..(634): n is a, c, g, or t
  misc_feature (861)..(861): n is a, c, g, or t
ggcggagcgagtttggttgcacttacaccggtacttaagcgcggaccggcgtgtccttggacttagagagtggggacgtccggcttcggagcgggagtgttcgttgtgccagcgactaaaaagaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaacaagggaggcaagcacaagactgggccaaaatctccatggtctctttggggcggaagacaggtcaggcccctggatactcttacacagccgccaaataagaaccaaagggcattcatcctggggagagggatacactggatggagtatttgggagaattccccaagaaggtacaattcccctggaaaccaaaaaatgatctttgtcggcattaagaagaaggaagaaagggcagacttaataggcttatctcaaaaaagctactaatgagtaataattggccactngccttatttattacaaaacaganaatgtctcatgacttttttatgtgtaccatcctttaatagatctcatacaccagaattcagatcatgaatgactgacagaatattgtggggcagtcctgattgaaactaagactggcttgtggttgaatgaatatgttcagttttgaagttgaatagtaaactccagttcagctaaatggtatcactgttgacccttttatgatatgattagacttcgttagtactn

SEQ ID NO: 55955 - DNA, 648 bp, Homo sapiens
gctcatctaagcctaagttggtctgcaggcgtttgaatgagttgtggttgccaagtaaagtggtgaacttacgtggtgattaatgaaattatcttaaatattaggaagagttgattgaagttttttgcctatgtgtgttgggaataaaaccaacacgttgctgatggggaggttaattgccgagggatgaatgaggtgtacattttaccagtattccagtcaggcttgccagaatacggggggtccgcagactccgtgggcatctcagatgtgccagtgaaagggtttctgtttgcttcattgctgacagcttgttactttttggaagctaggggtttctgttgcttgttcttggggagaatttttgaaacaggaaaagagagaccattaaaacatctagcggaaccccaggactttccctggaagtctgtgtgtcgagtgtacagtaggagttaggaagtactctggtgcagttcaggcctttctcttacctctcagtattctatttccgatctggatgtgtcccagatggcatttggtaagaatatctctgttaagactgattaatttttagtaatatttcttgttctttgtttctgttatgatccttgtctcgtcttcaaagtttaattagaaaatgattcggag

SEQ ID NO: 55956 - DNA, 205 bp, Homo sapiens
gtatttttgtagaggcggggtttccctatgttgcccaggatggtctcaaactcctgggctcaagcaatctgcccgcctcagcctccccgagtgctgggtttacagggtgagccaccatgcccggcccgcctgcgtctcttaaaggcttccaggatgtggctgcgttgggctcctagggccccgttctccaaacctggttctcctt

SEQ ID NO: 55957 - DNA, 310 bp, Homo sapiens
gagtgctccccgagtgtccaccgtcggcctgctctgttccggggcagggccacatctttgtccgtgtgccgaggaggggactggtgggctggagtcccagggggagattattccaagtaggggctccagaaagtggccagatggtgtgagtggctccagaagactcttctcttctctgtgcaagagccaggaaggctctagaaaggaatgtctgaggaagcatcggagactgggtcccgccatgcctgtgtcatctcctggcttccccggcccttatggctcgttcggaacaccacctggatacggctgc

SEQ ID NO: 55958 - DNA, 168 bp, Homo sapiens
gagtgctccccgagtgtccaccgtcggcctgctctgttccggggcagggccacatctttgtccgtgtgccgaggaggggactggtgggctggagtcccagggggagattattccaagtaggggctccagaaagatggctcgttcggaacaccacctggatacggctgc

SEQ ID NO: 55959 - DNA, 568 bp, Homo sapiens
ctatgacccataaaatggagctttgagcagcaaagctaccaagaaccacacagagatgcgggtgtgcctccctggggagagagccctgcaagcaaaagctcacttttactttcttaaaatagagctggaagggtttctgcctgtgtagcagctgagctgagacagttttcctttccagctgagggttataacctaatgcagctattctcctctctgcgtttcaaacgcagagaggaagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccctgcgtttggggaagcctct

SEQ ID NO: 55960 - DNA, 142 bp, Homo sapiens
ctactactgctcgaattcaagctgctaacgatgtacggggacatgggtggcactcagtctctcttctctccagctgactaaactttttttctgtaccagttaatttttccaactactaatagaataaaggcagttttctaaa

SEQ ID NO: 55961 - DNA, 177 bp, Homo sapiens
cattggataagcgatgggggtttggatgcaaacaggattggcgcttttgggtacatggagtgttcagcaaagaccaaagatggagtgagagaggtttttgaaatggctacgagagctgctctgcaagctagacgtgggaagaaaaactgtagaggctgatgggaggcagaggctggg

SEQ ID NO: 55962 - DNA, 653 bp, Homo sapiens
ccacgcgtcgcgaccacgcgtcgccacgcgtccgatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccaga

SEQ ID NO: 55963 - DNA, 218 bp, Homo sapiens
ggggtgggcagcagcatcccagccttgagatgctcactttccttctctgcaaccagatcgtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccaga

SEQ ID NO: 55964 - DNA, 136 bp, Homo sapiens
agcaccttcaggctagtccctatctgcagctgtggcagagttacagttctgtggtttcatgttagttaccttatagttactgtgtaattagtgccacttaatgtatgttaccaaaaataaatatatctaccccaga

SEQ ID NO: 55965 - DNA, 347 bp, Homo sapiens
gcggccagctactactactaaattaacagcagctcagacccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55966 - DNA, 741 bp, Homo sapiens
  misc_feature (15)..(15): n is a, c, g, or t
  misc_feature (47)..(47): n is a, c, g, or t
  misc_feature (61)..(61): n is a, c, g, or t
  misc_feature (75)..(75): n is a, c, g, or t
  misc_feature (660)..(660): n is a, c, g, or t
  misc_feature (665)..(665): n is a, c, g, or t
  misc_feature (741)..(741): n is a, c, g, or t
tgcggggggcgggtngcggcgggtcgggggggggcagcgggcggagncgtgcatgttctangtacgggggagcgncaagcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgtttgatgntcaantgttgagtaactggagaaattgtgctgctggaactgtgagcagctatcgtattgaggtgtatactaggtatctgcn

SEQ ID NO: 55967 - DNA, 583 bp, Homo sapiens
catctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggtcgcttggtcagctagacaagatggagtgagagaggtttgatctagacgtgggaaga

SEQ ID NO: 55968 - DNA, 843 bp, Homo sapiens
  misc_feature (742)..(742): n is a, c, g, or t
agagggccaagcggcggcggcggggtcctgtactcttgctgtggctgggcggctagttcaagttgccatagctgcgagtctggggagagcacagtcggttgagtcgctgcgtttggtcggttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagaggctggactcggattcgttgcctgagcaatggctgccatccggaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaganccggtgaaacctgaagaagcagaagcaggaagcaggccggagggcagaagcaggagcagagcaggaagcggggatccttagatcacctcagcagcaagctg

SEQ ID NO: 55969 - DNA, 1946 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaaaaaagggggcgctaattcctcgagggccataggtccgttttgaaaagggccaaagggttaaaagagg

SEQ ID NO: 55970 - DNA, 1926 bp, Homo sapiens
  misc_feature (1897)..(1897): n is a, c, g, or t
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaccagatgcggccggccccctncccccctccccctcaaccgctaacccacc

SEQ ID NO: 55971 - DNA, 1907 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaaaaaacaccacacaccgacaccacaaaca

SEQ ID NO: 55972 - DNA, 1885 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggaggcaatttgaagtgtgtttttagcctctctgtagccaggatacataacaaacaagactccagtttactggtgtgacatccagtgtcttgtctaaatacaatatgatagttttatcatgtaccaataaaatgtccgagtgtgtaatccaaagaaggccgtctttttcacgtcctgtac

SEQ ID NO: 55973 - DNA, 1632 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaaaaacccataccctttctttgaggatgacagtattaggaaatcccattataccaaaaatactacatctagtctgctagatatatttatttttggtaacat

SEQ ID NO: 55974 - DNA, 1829 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcattatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55975 - DNA, 1564 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatgcggcaagcctctcaataacttatttctcaacttatgttatttatacatc

SEQ ID NO: 55976 - DNA, 1560 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaatactcagtgactttgaataagtcggtgtctttgtgttgtggtgtggttgtttggtggatgtgtggcttggtgtcga

SEQ ID NO: 55977 - DNA, 1484 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaataatttttcccgaaaagttggttttggaaagggtccaaatggagcccaaaggttggttaccacaacgtgggaacaggaaataatcccgaatgaaggg

SEQ ID NO: 55978 - DNA, 1303 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactccctgtaaacagcgctatcaggattcttactctgttctttctagaagagacggtggtacttcgggattaggcgactccttatactaatgtctggcttatcggcgccgaggtccgggggccctcggttacccgacatttgggttctcggggcttggacggcccaaaccctctgcggggaactgggcgaccacagggtgccttgtcaattccctcggtgttgccccatgtggagatgtaacgcttgttcctaggctaagctctccg

SEQ ID NO: 55979 - DNA, 1720 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaaaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55980 - DNA, 1817 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55981 - DNA, 1782 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatgagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55982 - DNA, 1666 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55983 - DNA, 1319 bp, Homo sapiens
ctacgcgtaactatctcttccccccccttcgcgcaccgcaatagatatactgaagtgactctcttattaaccaccgctcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55984 - DNA, 1098 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtcccttttattgagtcaccgctgtccccggccttatggttaagcccttgtccctgagcaggggttagaattttcttcttcaaaacggttgtgggggctcatccgacttcggcggcacgccatgttcggggcaccctcctctctctccctttt

SEQ ID NO: 55985 - DNA, 1225 bp, Homo sapiens
gactctagaaggatccccccacaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55986 - DNA, 1229 bp, Homo sapiens
tcgctgatccgcttaggaaaaaccgcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55987 - DNA, 1651 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55988 - DNA, 919 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcccgcacatccgtactgacccggtaccgagctc

SEQ ID NO: 55989 - DNA, 1340 bp, Homo sapiens
cgtcgacacggctgctttaagacgacagaaggaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55990 - DNA, 964 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgatacactaagattaatacaaatctcttagattccaaagaggttgaataattaatgttcaaaggcaagagggcaaggcattttttaacactttttaaaataaaaatttataccac

SEQ ID NO: 55991 - DNA, 761 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagcctcactgtgtcgccaggctggagtgctgtggcacgatcttggctcaactgcaacctccgcctcccagatttaagcgattcccctgcctcagcctcctgagtagctgggttacaggcgccc

SEQ ID NO: 55992 - DNA, 740 bp, Homo sapiens
  misc_feature (639)..(639): n is a, c, g, or t
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaganccggtgaaacctgaagaagcagaagcaggaagcaggccggagggcagaagcaggagcagagcaggaagcggggatccttagatcacctcagcagcaagctg

SEQ ID NO: 55993 - DNA, 160 bp, Homo sapiens
gattaaccttgcactcttgtggttgtttttcccattacagtagagttggctttgtgggacacagctgggcaggaagattatgatcgcctgaggcccctctcctacccagataccgatgttatactgatgtgtttttccatcgacagccctgatagtttag

SEQ ID NO: 55994 - DNA, 641 bp, Homo sapiens
gaggacaggcccccaccgcagcacaggaccaaactccagcctaaagtacacagcaaatagcccagcacgcccaccgctcatgccccgtgttgctacatctcgccctgtacagctggcttgtcggccttgggatgagtaaggtctatgggcttttgtttttactggtctgccaacaagcgcctgccacaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtcagctcatagtacattcattcgttcattcattcattcattcatttttgagacagagtcttactctgttgcccaggctggaatacagtggcatgatctgccctctgcctcccggttcaagtgattctcctgcctcgtctcccgagtagctgggactataggtgtgtgccacaagcgcctg

SEQ ID NO: 55995 - DNA, 573 bp, Homo sapiens
agcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccggtagtctcctgtgccccttcccccgcccggccgggcctggtggagcccaggctgcccgcctgcccgccctcggtccccggagcttcctctcccagcagcgccgggcagggcgggggctttgggccgggccccgcgaccgcgcagtgtagccggccgctgaaagcgcgcgtggctgtcggagttgaaatgggaaagaaactctttacaactccattttgctttttacgtttaacgagaaacgacaatcactgttttatattgattaaagtccagttacactttgggtaggttttcttttaatgcagacttgttggagactgtgtaagtaagtaaaagattgtattgaacgcttaggggtatgatctacggccataccacctcgaacgcgcccgaactcgtctgaaagc

SEQ ID NO: 55996 - DNA, 1875 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 55997 - DNA, 1937 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaaagagaacaacgaaaaaacagaaacaacacacacgagacaaagagcgcgcacaacaacg

SEQ ID NO: 55998 - DNA, 2239 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaaaaaaaaaaaaaaaaaaaaaaaaaaaaaaaaaaaaaaaaaaaaaaaaaaaaaaaaaaaaaaaaaaaaaaaaaaaaaagggggggggggccggccacacactcccccgcccgagggcgcccacacgcccgcaccccagcgtgtcgctgatcaagagggacgcgaggcagctactatagaatgagtggtcttttattgtcttcggctggcaggtgggagctgcgcgtagtttatttcttcacagcagaatcgggtggaggagagaaacaagcggtgcgcgttgtgctgtgttcaggttgtgcccactctcatatttgttctgggtggacgccagtaatagggatggaggaactcttcgtctta

SEQ ID NO: 55999 - DNA, 2281 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggccggccacacactcccccgcccgagggcgcccacacgcccgcaccccagcgtgtcgctgatcaagagggacgcgaggcagctactatagaatgagtggtcttttattgtcttcggctggcaggtgggagctgcgcgtagtttatttcttcacagcagaatcgggtggaggagagaaacaagcggtgcgcgttgtgctgtgttcaggttgtgcccactctcatatttgttctgggtggacgccagtaatagggatggaggaactcttcgtctta

SEQ ID NO: 56000 - DNA, 1834 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactagaggggccggagatcctctag

SEQ ID NO: 56001 - DNA, 1788 bp, Homo sapiens
tatgctctcgatctgagaacatagcttgtctcgattagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 56002 - DNA, 1554 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatgcggccgactacacttataacctaatatatctacgaaatc

SEQ ID NO: 56003 - DNA, 1408 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccaga

SEQ ID NO: 56004 - DNA, 1856 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggatcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 56005 - DNA, 1814 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 56006 - DNA, 1012 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgcccgctaggggacgggtaccgagct

SEQ ID NO: 56007 - DNA, 1623 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 56008 - DNA, 1816 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 56009 - DNA, 980 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtgggttaccggaggctcgaatttcgtaaatcatt

SEQ ID NO: 56010 - DNA, 934 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcccgcgggccagtacggatgtggatatcgtggagcaggtctgaggggt

SEQ ID NO: 56011 - DNA, 1026 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtggctggccgggctccaggtggaaatgcccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgccaaatgcttcatacttccggggcaaaccaagaataaccacgcgcataagaaaggggtgccaggtaagaacgggcaagagaatcagagtcatgagaagcccgaagccccgcccagcatgag

SEQ ID NO: 56012 - DNA, 662 bp, Homo sapiens
ccccaccaccctctctcccctctgcgccctctaactaagtctaggtacgaggcctgggtgttccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtctt

SEQ ID NO: 56013 - DNA, 1421 bp, Homo sapiens
agctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctctgtcttgcctatggagtagccatcctttctttattaacctgctttcactttatggactcccctgaattcttctgcaggagatccaagaaccctctcttggagtcttaaccaggatccctttccagtaacttcagcaggatctgtgagtgccagtttccttctgtggtgcaaaactaggtgctaagtacactttttcccccctttcctctatttttaaaagaactttcagcccttttgaagtgggtacattgtctggagtacataccctggggttcattgttataggagaatttaggacacagacacacgaggagtttaggagcagaggtttaataggtaggaagagaagggaaagagaaacagcttcctctatagatgtctgcactgacaccgtggctttaaggcatggcccatgatgtgtctccgagtggaaaagactggttggtggtgaatgcgccaaattttatagtccggtttgaggaggtggtttctgattgggttgcatcattgtatgacgtttgcaaagtgcatgtggaaggctggtcgccccacccctaatcttatgcaaatgggctttcccagttgattgggtccatcttgtgtaacacgtggctggcagagaagggaagatgaagccacccatcttgaaaatgtctagtccttagtttctgctggcattcaccccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgtttagttaactgtttgtaaaaataaatggttagtagaatgtctaattcaataaatgtttcataaatgagtaaaaaaaaaaat

SEQ ID NO: 56014 - DNA, 440 bp, Homo sapiens
ggtggggacagagtgttgctctgtcacccaggctcgagtgtggggtggtgtgatctctgctcactgcaacacctgtaatcccagctacttgggaggctgagacaggaaaatcacttaaaacccaggaggcggaggttacagttagctgagattgcgccactgcagtccagcctgggtgacagagtgagactctgtctcaaaaaaaaagcgaagttacatgcaataaaatcacacagaaaaattatttttaataaaaaattaaaacaattgacagatatcagttatatgatttattgttccaactgttatatgtgtatttctgagtgccctttggcttcttgcccggtggtacttgaagtcataggataaacatggcatattttccttaagtgtcaatattactcaacaaatataggttaaaaaagcattctatctgatgt

SEQ ID NO: 56015 - DNA, 303 bp, Homo sapiens
ggaggactggctctaggtcctctcaggtgagaaggagagaaaccgtggcaagtcagggaactttctgatgggaaagctaaagtttggaggtgttcaggaagtcgcccgtgctgccggagaaaccgagactcgctcttgggacggttgcaaacagctccggagaaactcagcccgcagcacgccgcccgccgcccgccgcccgcttgtgcgcccgcaggttcctcgccgtggataatctgcccgagctgcttcgcaggcccggccgccaggcttggggatttagagccccatctgtttgcggcg

SEQ ID NO: 56016 - DNA, 263 bp, Homo sapiens
tatccttttctaggagaccctattctactgagaccactggcagggctgagtgtggtaaggctgaactatgacacaaacaggatatgaccaagtatgtttgttgtttagcttttgttgtttggcttttgtttacaaaaagcttaaaaataacaaaatttggttcttgtcctggtcctacagagttgattctaggccaactgtctctcttgcttttggtatggcattaccaaggtcaagcttgcagtctgatctccaccttagta

SEQ ID NO: 56017 - DNA, 2731 bp, Homo sapiens
gtatcccccaaattcctctgcagaggctcacaccccaaggtgactgtcgctggagataaggtctttaaggaggcaatcatggtaatatggcagcttaagggtgggaccctcatccaacaagactggtgtcctcctgagaacggaaaaacactgaagaccacacacacggaaaagaccaggtgaggcacagaatgggaagaagccaaacctgccagtgccttgatcatggactctcaacctccagaactgtgagaaaatacgtttgggcctcccagtctgtggtattttgtcgtggcagcccgagctgactaacgtaggcgccaagcccctccagagccacgtggcacccgtggctgatcagcctgccatgctggcagatctaccctgtagggccaaaaatgcttctacctgcaactgcccatcaataacatctgcatggctgtttgcagagggcaaccaaagaagaaagttcagtcccactgcaccaacccagctgatggaacagagtcccacatggcactctcctaaactgggcagcgacgccacttacttccagaatacagggaagattctgaagcctgccggggagctgagtggacccgcatgcactcactcatccactccacaggcatttgtcccagggtctccaggtatgatgggaagccagggtgcacagggccagaggcgacaaacacattcctgccgggtcccagagaacggaggctggccaggaatacgggcggcatgaactacgctcaggctgcaggtgccaagcacttacacttgtttcctttggagtaaagctagaggaaacagaggctccaaattcaaaaggctttcctgaaagcacacagctagaaagaagctgcaccagacttcacttgaggactcttcttagacatgacatatactgcctctcaacaagcagctgtactgtggaggagaaagtagaaaagtgccacaagagatttaaaaaaaataataataatgctcctgggcctgagacagggaaggagtacagcatttctgttttatttctgggggctggggagcagagcagaacattcaggaaagacattcattctgcaagcatttactggggatatactattcgccaggcatgcatgtaaaagaggagccacgtgcccagagggatgggaagacagcacgttccaaccatgaagtcggggagcagaaggaagcacaggtgagggagagtccatgggaactggcgggccagcagcagcagcagcagcagcagcagcagcagcagcagaggagcccatgcggcaggaacaggagcccatacctgagcactgaggcacccagccacctgtcacgatactcggaggactgggctacagaggccgcacaccccagcaaccaacttctccccgctcctagcaggcccttaagtcgctgttgctgagctcccctcacccccttaaatatctctttcccaccaagatgcaaaaggcaacaccatcctctagcatttgcccagctctgtgcgtgtttaatttccttactatttgcaagaagtcattcaaaatgttgacagcatcttaacagtttgcacatgatatatctgcacatcttacaggttagcatccgtgtcaaaagtcaccaatgaacacattacaatctctccatttccattctcttttaaaggctgcagaatgtctggttcaacactaagcagacttttttccgcaaaattacaaggaaacactgaacaagggcagatgcacaaaatgatacccatgacgcctgacaaacaactccgtgttgacagaacagctcgaggcccttccccattccagtggatcagcgctgttattgccagctcagtatctacgcccctgtctttcagagaaccttttcagtgttcctttgaggacctgccctgctcttctctctgctgccactctgatgaggctgtccatgaaaggcctcccctggccaagaagtggcagaatctgggccaataaaccactctccaggcaacccaagcagtgccctaaatacacaggcagcctgtgcctgtcccctgggcccatggttcagtccatcccaacgcctctatgctcaaagccacccccacatccttcgaataaaatccatgtctgcttgagtcagccagaatgggattctcatgtttccaaccaaggacccaaagagtcaacttaccacagtgcccagcttgaagggtaaacaagttctgacagttctaaaaggcaaagaccatctgcttaaggcaaacattacctaaatttaaggacttttttaatgccctaaattctgatggcaactcccaaagaaaagattcccaaaatggtggccatggcaacctcaatggcctgagtatacaagctccccaactgaccaatacggctgcaggccccttctctgggacatgagtcattgaacatctgatctaaacaccaggtatgttccttgttgctacacagactgtgccctacaagccagagtccatcccgcctccctcatgcagttaagctccatggagctctcaccacgtgtccagtcctggatgagacaccggggtttggttcctgagcaccttgagcccatgctggggagagacgtgcagcccacgtcacagcaaagtgcacaggccaccaggtggcaggccctggaatcgccagcaggagccatcggaatggccttggggaagcaggactcctgagctgggttgtgaaggcatcag

SEQ ID NO: 56018 - DNA, 233 bp, Homo sapiens
gcggtcttctagaggatcccggcacacgtgcgtataactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56019 - DNA, 1755 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56020 - DNA, 1933 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56021 - DNA, 2119 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56022 - DNA, 1638 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56023 - DNA, 1662 bp, Homo sapiens
tgacataggctagtaggagcctggtggttaatcggccgagggatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56024 - DNA, 1946 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggtaggaagtgggtttggtgcctggctagaaagagcctagggaaatggactggagggaggcaaaggtgctgggtgcaaagtgagaaggataggtgcttgggtcagagtagtcttactgttcacttcctttccagctttatcccatcctttttaaactctgggccattggtcctgttcccttgttttgtcaaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56025 - DNA, 2178 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggtaggaagtgggtttggtgcctggctagaaagagcctagggaaatggactggagggaggcaaaggtgctgggtgcaaagtgagaaggataggtgcttgggtcagagtagtcttactgttcacttcctttccagctttatcccatcctttttaaactctgggccattggtcctgttcccttgttttgtcaaggttcctacacgaaaggattatggatccaaagtcagtctcttctctcacctaccccagtacagcagacaaaactctctgacccagtttatgaggtaggatcctatgaaattgtcataacttttgagtctgaggagttttagtaagtcagtattgaaagtttctagtaatctgagatggactctgtaggaaaaagtatgaacccaaggcagaactgtagaggagtggggaaatctgctagtgaagggagttccttttcatcaggggcaggtgggcagtagatgctcaagctccctttcaaagtatgtgacaccgccatcccatcagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56026 - DNA, 1711 bp, Homo sapiens
  misc_feature (1660)..(1660): n is a, c, g, or t
  misc_feature (1664)..(1664): n is a, c, g, or t
  misc_feature (1666)..(1666): n is a, c, g, or t
  misc_feature (1670)..(1670): n is a, c, g, or t
  misc_feature (1672)..(1672): n is a, c, g, or t
  misc_feature (1675)..(1675): n is a, c, g, or t
  misc_feature (1677)..(1677): n is a, c, g, or t
  misc_feature (1680)..(1680): n is a, c, g, or t
  misc_feature (1682)..(1682): n is a, c, g, or t
  misc_feature (1687)..(1687): n is a, c, g, or t
  misc_feature (1698)..(1698): n is a, c, g, or t
  misc_feature (1704)..(1704): n is a, c, g, or t
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaaaaaaaaaaaaaaaaaaaaaagnaaananaaananaananagnanacaanaagaaaaaaanaaaagnggggggg

SEQ ID NO: 56027 - DNA, 1776 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatggtatggtccagaccttgtgactgagcagattgggagtatggaatgatctgaagaagggactacccacttgcctttgggaataagttagtcatcagttactgacatttataactgaatcctcctcttcattcactctagctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56028 - DNA, 2031 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacctgtgggtaaaattaagaaacatgttaaaaactcccgggaaggccaacgtaagcctttttttgccctagtcaagggttaaggaatggtttggccattctgacttgtgccatctctgagccctctataggcttgtcatcatacacatattcaagcacctggcatgatcatcagagggataaaagtgtccatttcttgttcactaaggattttactccatttaggccaagtcagaacttcgagcagccattgatcggtatgtgcaagagaagattgtgctagcagctcaggcaatttcacgctttgcttaccagaagatcagtaatggagatgtgatcctggtatatggatggtatggtccagaccttgtgactgagcagattgggagtatggaatgatctgaagaagggactacccacttgcctttgggaataagttagtcatcagttactgacatttataactgaatcctcctcttcattcactctagctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56029 - DNA, 1542 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56030 - DNA, 1635 bp, Homo sapiens
tgacataggctagtaggagcctggtggttaatcggccgagggatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56031 - DNA, 2079 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgaggtagggacaacactataagtccactcccagctcgcccaatctttgtcttgtactctttttcctgcttttctatctctcttttcattttgtgttctattttctttttaaagactttttttttaaatgtgaaggctttgtaagttgtgaagagttgcgcagatataaggtattgctgttgtattatagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacctgtgggtaaaattaagaaacatgttaaaaactcccgggaaggccaacgtaagcctttttttgccctagtcaagggttaaggaatggtttggccattctgacttgtgccatctctgagccctctataggcttgtcatcatacacatattcaagcacctggcatgatcatcagagggataaaagtgtccatttcttgttcactaaggattttactccatttaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56032 - DNA, 2123 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaaactctgctgcctttgtttctcttttagcatctccaccacttaagttaggagtccagacttcacaaccccttttatcacctgctactcagacctttgtgaagacctgctcaagtaactagctccatgccagtacattgggactaacctgaagacccgtataaagaaccaaaactacccaaatcaatcattcactgagcatctacatgccagacactaaactgggtgtgaggaggaatatgaaaacaaatagtcctgggctgagtgcagtgactcattcctgtaatctcagcattttgggaggctaaggcaggaggattgtttgagcccagaggtttgagaccagcctgggcaacatggcaatccggtctctacaaaaaataaaaattagctgggcatggttgtgctcatctgttgttccagctactcaggaggctgaagccagaggattgcttgagtccaggaggtagaggctgcagtaagccatg

SEQ ID NO: 56033 - DNA, 1724 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaaaaaaaaagaaaaacgataacagatagagaaacgaggacatgtacagagctcgagaaagtactagtgggcacgtgggccgtgcacct

SEQ ID NO: 56034 - DNA, 2022 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56035 - DNA, 2762 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtatgtcccatcctgttctctcttatgatccaaccccacctcccccaatactaccccagcttctgtcacccaaggtcatctctgggggacagagggaatactcctaccctcagaacattttcctcagtgaagcttacccccagcccccgttcagagatctttattaaggggtattttgcagatcaccttgtgtaccctataggtgattcaggattacacaacaccgcctaatgaagaactctccagggatctagtgaataaactaaaaccctacatgaggtagggacaacactataagtccactcccagctcgcccaatctttgtcttgtactctttttcctgcttttctatctctcttttcattttgtgttctattttctttttaaagactttttttttaaatgtgaaggctttgtaagttgtgaagagttgcgcagatataaggtattgctgttgtattatagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacctgtgggtaaaattaagaaacatgttaaaaactcccgggaaggccaacgtaagcctttttttgccctagtcaagggttaaggaatggtttggccattctgacttgtgccatctctgagccctctataggcttgtcatcatacacatattcaagcacctggcatgatcatcagagggataaaagtgtccatttcttgttcactaaggattttactccatttaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56036 - DNA, 2576 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtatgtcccatcctgttctctcttatgatccaaccccacctcccccaatactaccccagcttctgtcacccaaggtcatctctgggggacagagggaatactcctaccctcagaacattttcctcagtgaagcttacccccagcccccgttcagagatctttattaaggggtattttgcagatcaccttgtgtaccctataggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacctgtgggtaaaattaagaaacatgttaaaaactcccgggaaggccaacgtaagcctttttttgccctagtcaagggttaaggaatggtttggccattctgacttgtgccatctctgagccctctataggcttgtcatcatacacatattcaagcacctggcatgatcatcagagggataaaagtgtccatttcttgttcactaaggattttactccatttaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56037 - DNA, 937 bp, Homo sapiens
cggacgcgtgggtccggacgcgtgggtccggacgcgtgggtccggacgcgtgggtcgacccacgcgtccgctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56038 - DNA, 1730 bp, Homo sapiens
  misc_feature (1585)..(1585): n is a, c, g, or t
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtaagtacagaggaaaaggactccaaagttggcggtgaaaaggtgtagtagtatagacataatctcaccttcccaaagttaaacagttttgtttttgttttgagataaggatggagtgcagcgacgtgatcacagctcgctgcagtcttgacctcctgggctcaggtgatcttcccgcctccgcctctgagtggctgggactactggtgtgtgccaccatgcccagctagttttttatttttcttgtagagatgggatatcgctacattgcccaggctggaactcctgggctcaagcagttccccctgtctcggcctcccaaagtactgggatcataggcatgagccactgtgcccagccacaattatttaaaaantattagaattatatagccctggcttggtgccatggctcaatgcctgcaatctcagcactaaggcaggaggatcacttgagcccaggagttcaagaccagcctgtcaacataatgagacctgtacacacacacacacacacacaca

SEQ ID NO: 56039 - DNA, 1503 bp, Homo sapiens
cacgcgtcgcccacgcgtcgggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgaggtagggacaacactataagtccactcccagctcgcccaatctttgtcttgtactctttttcctgcttttctatctctcttttcattttgtgttctattttctttttaaagactttttttttaaatgtgaaggctttgtaagttgtgaagagttgcgcagatataaggtattgctgttgtattatagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacacctgtgatctcagcacttgggaaagccaagggtgggaagatcatgggaggattgcttgaagctaggagttcaagaccagccggggcaacgtagcgagacccatctctaccaaaaaaaaaaaccctacttgggggataaaggataatggggtactccgggattgggaggcaatcaggggacagcatggaagaatgtgtgctcgggcccggataagagatggggacatcattccagtacactagttgggatgggcccaagggtctcttcacagacgcttctggtaagccagagtgggacccttggtaacataccttatgatacgaatggtttcaagaataaatggttttcaccagtgtgttacacaaaaaacaaaaacaagg

SEQ ID NO: 56040 - DNA, 428 bp, Homo sapiens
ccagagaatcgagccggtaccggcatgtgctcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 56041 - DNA, 965 bp, Homo sapiens
  misc_feature (926)..(926): n is a, c, g, or t
  misc_feature (933)..(933): n is a, c, g, or t
  misc_feature (953)..(953): n is a, c, g, or t
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcagccttaaggnagttaangggttcttccctttaagttnccctttaaggtt

SEQ ID NO: 56042 - DNA, 1292 bp, Homo sapiens
agtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgacccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaaaaaaaaaaaaaaaataaaaaaaatccgggggttttattgggggggggaaaaaggggtataaaaggggccgggcattgttttccgacccctttttgtaaggggaaatgcggggcccaaaggagggatataataaagcggatctt

SEQ ID NO: 56043 - DNA, 390 bp, Homo sapiens
gtggaggaataaacactttgttcaacttttttggttaagaaaagcagctgaggatccaattctcagctccttctctgatctcagagtgagaatagcccagaatggagatgtttgttcaaaagagttaaatttcctttgtataataaagtaacagtaatcagatattttcagggagaggtggagggcagtagagagatggagggaaaggattggggaaagggagaaatggctgcaggcagggctctgggaggcagagcagccaggaaaaagggtgctgggcacgctagtgtgacgattttcagcacttcctggtccgagtggtgctgtcacaatcctatgttgccctgacctttagttaaagtcttccaggcaaaatgaccttaagtcctg

SEQ ID NO: 56044 - DNA, 207 bp, Homo sapiens
tataaggacaggaaatgtcaaatgacttacccagaatctcacggataatcattatgggatttgaactttaaacctaggtctttcttattccactacgtctccacactgccatataacacacagttccaacaccaaaggaacttcagagctatctggagaggtgtgatgtgaaccaagtaagtttcagtgtgttccctggagaatgag

SEQ ID NO: 56045 - DNA, 633 bp, Homo sapiens
actaatttccgtttcagaatctacttcccagggaatccaacctgtgatgccccttgagaaaaactatacctggaggattagaatgtgtgtcccctgtggccagcagccacgaggaggaagggtggcagaaactagcatgcccagtttgtcctttccaaatttacaaatcataggtcattccaccttccctgagatagaatggttaagtatgtggacatatgccaggatttacaccacctgtgtttcttcaataaagtgggaaacattgagataatatccagtgatattaaggagctagattcactaggaataaatgtattagatatagttgaggaaaaatagcgccagtcaagaattaccgatgggtcttaggtaactgagtaggtggtagtgtcgtttaccgagattaaaaaaacaagcctggagggatctatgagtttcatttgaaatgcctttgggatgtcaaagcaacttgttcactaggcaattaaagatataaatctggagtccaggaacatgacctagagaactgatatgaatgtatatacatacctatcagcatacacccagtaatgactggtatcccgcaaggccgacagatataacttagggaacagaagtcagttaaaaaaa

SEQ ID NO: 56046 - DNA, 120 bp, Homo sapiens
cttttcctcataatgacttacctatgcaccaaattgatacttttataactatcttttattactgtccttagaagaaaattgtttccctttgaatgatatttcagaaggatttttttgaag

SEQ ID NO: 56047 - DNA, 380 bp, Homo sapiens
gccaatatgaactttaatagggaaagatgtaaagaaaaatgtcagttctctccaaattaatctctgtattcagtgtacttccagtcataattacaaggaaatttttcatggatcttgaaaaactgattgtaaaattgatatagacaagtaaatactcaagaataatcaagagaaccctagaaaaatgtattgcatctgacagcaagatttactacaaaatcataataggacagtatgggtttgatgctaggatggacaattaggtcagtggagcgtaatgggaaagcccagaaacacattgagatccttgtgaaattttaatatataggaaagagacccctacaaatcaacatttatttaataatactgagtgagcctct

SEQ ID NO: 56048 - DNA, 300 bp, Homo sapiens
attctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtag

SEQ ID NO: 56049 - DNA, 1122 bp, Homo sapiens
aaatctagatggtatagctttgtacacacccaggccatatggtatggcctattgctcataggctataaacctgtacaacctgttactgtactggacactgtaggcaactgtaacacaacagtaaatatttgtgtatttaagcatatctaaacctggaaaagtatcaggaaaaatgtggcataaaagctccattataatatgggtccactgtcatatgtgtggctcattgttgactgaaatgtcattttgttgcaaataatgatactatcacattgatgattaagttttaacatatgaattttgtgtgtgggggtgacacattcagaccatagtacccagcaacaattaatgtatgaatagacaaaataaatgtagtatatcctttcaatggaatgttatccaaccataaaaaagaataagttactggtatatgctgtaatatggatgaaccttaaaaacattatgctaaatgaaaaaataagctagatacaaaaggacatatattgtatgattccatttatgttatgtgaaatatttagaatagataaaatcataaagacaaaaggcagattggtgaatgccaggggctgagggagggagaaatgaggagtgactgcttaatgagaatagtgtttctttttggggtgatgaaaacattttggaactagatagaggtgatggttgcccattatgaaatgtactaaatgccactgaattgtacactttaaaatggttagttttatggtatgtgaattttacctcaattttttaaagttcagaaaaaaaaagctttgagtctgtgaaacaaacaaaccccaaaatcaaccaaacaaaaagtaagttaaaaaaattagggatgagtttccaatatgacagtcactggccacatttagttggctgttgagcacaggaaatgtgcctagcccaaactgaggcttgttgtgagtgtgaaatttacactgatcttcaaggctttggtatgaacaaaataatgtaaactaggctggacgcggtgactcatgcctataatcccagcattttgggaggctgaggcaggaggattgcttgaggccagcagtgtgagatcagcctgggcaacatagtgagaccaccatctctacc

SEQ ID NO: 56050 - DNA, 551 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56051 - DNA, 2735 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56052 - DNA, 552 bp, Homo sapiens
  misc_feature (6)..(6): n is a, c, g, or t
  misc_feature (8)..(8): n is a, c, g, or t
  misc_feature (26)..(26): n is a, c, g, or t
aaaccntnggctaggtacgaggctgngtggtgctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56053 - DNA, 565 bp, Homo sapiens
gcctgcggccgctactactactactaaattcgcggccgcgtcgacactggagacgcgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56054 - DNA, 554 bp, Homo sapiens
aattacggctaggtacgaggctgggtggtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56055 - DNA, 544 bp, Homo sapiens
agacgacagaagggccccgggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56056 - DNA, 567 bp, Homo sapiens
cacgcgtcgccacgcgtcgcggacgcgtgggtcgacccacgcgtcggctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56057 - DNA, 561 bp, Homo sapiens
  misc_feature (7)..(7): n is a, c, g, or t
  misc_feature (21)..(21): n is a, c, g, or t
  misc_feature (48)..(48): n is a, c, g, or t
acccgcncgaaccgccgctcnacccggttgcgagaagacgacgaaggncgaagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56058 - DNA, 774 bp, Homo sapiens
  misc_feature (251)..(251): n is a, c, g, or t
cggtcctcaggtcctccatgtgtgccacatgcctccccctaaagggtacagggtctgcggaaatcgcgcattccacaaaggcggcccgttcatggagttggtttccattctttaccgcgatccccaactgtttgtgtagaccagtcatccgaggaccagacatcacagaaacttggctttcttgaagaagtgtatcttttgaatttgtgggggcttattcgtttgaccacccttaggagttcttgggggtngatctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56059 - DNA, 557 bp, Homo sapiens
cgcaaaagatagtgtactaggtgcgtgcccgggtgtgacttagtcgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56060 - DNA, 557 bp, Homo sapiens
gcgacaagacgacagaaggggctctcccgggtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56061 - DNA, 564 bp, Homo sapiens
  misc_feature (25)..(25): n is a, c, g, or t
aaaataggctaggtacgaggctgtngtgtttgaattcggcgaggctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56062 - DNA, 754 bp, Homo sapiens
  misc_feature (642)..(642): n is a, c, g, or t
  misc_feature (665)..(665): n is a, c, g, or t
  misc_feature (673)..(673): n is a, c, g, or t
  misc_feature (676)..(676): n is a, c, g, or t
  misc_feature (678)..(678): n is a, c, g, or t
  misc_feature (680)..(680): n is a, c, g, or t
  misc_feature (692)..(692): n is a, c, g, or t
  misc_feature (694)..(694): n is a, c, g, or t
  misc_feature (708)..(708): n is a, c, g, or t
  misc_feature (723)..(723): n is a, c, g, or t
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaacaaaaaaaaaaaaaaaaaaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56063 - DNA, 738 bp, Homo sapiens
  misc_feature (626)..(626): n is a, c, g, or t
  misc_feature (649)..(649): n is a, c, g, or t
  misc_feature (657)..(657): n is a, c, g, or t
  misc_feature (660)..(660): n is a, c, g, or t
  misc_feature (662)..(662): n is a, c, g, or t
  misc_feature (664)..(664): n is a, c, g, or t
  misc_feature (676)..(676): n is a, c, g, or t
  misc_feature (678)..(678): n is a, c, g, or t
  misc_feature (692)..(692): n is a, c, g, or t
  misc_feature (707)..(707): n is a, c, g, or t
aattacggctaggtacgaggctgggtggtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaacaaaaaaaaaaaaattcggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56064 - DNA, 701 bp, Homo sapiens
  misc_feature (574)..(574): n is a, c, g, or t
  misc_feature (588)..(589): n is a, c, g, or t
  misc_feature (609)..(609): n is a, c, g, or t
  misc_feature (611)..(611): n is a, c, g, or t
  misc_feature (640)..(640): n is a, c, g, or t
  misc_feature (644)..(644): n is a, c, g, or t
  misc_feature (647)..(648): n is a, c, g, or t
  misc_feature (651)..(651): n is a, c, g, or t
  misc_feature (654)..(654): n is a, c, g, or t
  misc_feature (657)..(657): n is a, c, g, or t
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaacaaaaaaaaaaaccncgggccgaattcgnnacaggcccaaaagaaggggngntccagaagccctaggtcccagggtccgcncaanggnnggncanaangggggccgggcgagcattccttcaaggaacgacccgggggagac

SEQ ID NO: 56065 - DNA, 877 bp, Homo sapiens
  misc_feature (585)..(585): n is a, c, g, or t
cacgcgtcgccacgcgtcgcggacgcgtgggtcgacccacgcgtcggctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacaaaaaaaaaaaaaacnggggggggggggaaaaacccggggaggtttccagggttcgcggaccccagcggcgcggatggtggaaatcctcccttgaagggagtcctaatagcatcgttcgcacaagaaaaggaggggtcaccccagggcacatcacaggcaagccgaccaggcggtcctaagctgaagccgggggggcacagtgaaattccagggctcccccatgtggtaatacgggccgggcccggggggccgaagcctacacctgaaaaccagggcgggcatcacagggcacacttcgcgaatcacc

SEQ ID NO: 56066 - DNA, 629 bp, Homo sapiens
gcctgcggccgctactactactactaaattcgcggccgcgtcgacactggagacgcgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtcaaccctcatttttttagggtaacagatttacaccccatgagaataagggctcctggtcccccg

SEQ ID NO: 56067 - DNA, 906 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaccggagggtcttatggggggggggaaaaaagggttggaagggcaggtcataggcggttccctgacccggttttttggtacaagggggaagaatctgggggtccccaaagggagggcgattaaattcgaaagccgggtaactgtagtatatgggcaaaaacggggagcgatagaagcaggagacacgcaagacgacgagagggacaaacagctgtagacaaaaccaggccaagaaacagcaaagcagggcatacagagtcacccaccaccacacagagacacgaaaaccaaccacaccccaccgacacatcaaacaccgcacagaacgaagcacgacag

SEQ ID NO: 56068 - DNA, 573 bp, Homo sapiens
agacgacagaagggccccgggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtagcggacgagcattccgctgatgggggct

SEQ ID NO: 56069 - DNA, 661 bp, Homo sapiens
  misc_feature (6)..(6): n is a, c, g, or t
  misc_feature (8)..(8): n is a, c, g, or t
  misc_feature (26)..(26): n is a, c, g, or t
aaaccntnggctaggtacgaggctgngtggtgctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacatgacgaacttcttgctttaactctaggtggtgccaggtacctaattcggcctatagtgagacgaattacaattcactggccctcgctttacaacgtcgtgactgtg

SEQ ID NO: 56070 - DNA, 1016 bp, Homo sapiens
  misc_feature (25)..(25): n is a, c, g, or t
  misc_feature (611)..(611): n is a, c, g, or t
aaaataggctaggtacgaggctgtngtgtttgaattcggcgaggctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaataaaaaaaagacaaaaaaaaaaaaaacnggggggggggggcctaaaatttcccccggggggccccaaatttcggcttcccccccgtttgttgtggacacaggggtgggccccccataggagaacgcgacaataaaacacacaagagaagagggacgacgattataaaacaccagcggggcgaaatgtgaaaaaagccattccacggggaagaacatctttggggaaagaaccccacatatttgcgtggggggaggaaccattgtggggccgcaaaccaccccctcagagatattataaagcctccggggggagaattaaacacacgtgtgcacgtgatattatgttggtgttaacaccaccgtgcaaaatgttgatgcgcctcgagaaaaaatttggtcacgacgagttattttatgaaccaattataccgga

SEQ ID NO: 56071 - DNA, 593 bp, Homo sapiens
cgcaaaagatagtgtactaggtgcgtgcccgggtgtgacttagtcgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttctcatggttttctgtggtgcttctttcggtgttcg

SEQ ID NO: 56072 - DNA, 589 bp, Homo sapiens
  misc_feature (7)..(7): n is a, c, g, or t
  misc_feature (21)..(21): n is a, c, g, or t
  misc_feature (48)..(48): n is a, c, g, or t
acccgcncgaaccgccgctcnacccggttgcgagaagacgacgaaggncgaagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtatatctctcgctcgggggaggggtggtc

SEQ ID NO: 56073 - DNA, 728 bp, Homo sapiens
gcctgcggccgctactactactactaaattcgcggccgcgtcgacactggagacgcgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttagaggatgtcacccccatcccctctgacagcactcgcaggaaggggggtcgccgtggtcgccgtctgtgaacaagattcctcaaaatattttctgttaataaattgccttcatgt

SEQ ID NO: 56074 - DNA, 640 bp, Homo sapiens
gtcccgtgccatagcttgacatgcctcgccaggtccgaactcctagaggactcccctggtggtcctactggtaggtagctccctccctccctccttgtagcgaaggctcttctccctgatctcccctgagctgaactcactatgaagtgcacctccgtaggggatattaatgccttctcctcatagcggattcttatgtagttactctccaactcgagaacgagctacttactagacaggttccgtgtttacctttttcctgtccatgtcaccgatctttctggccaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56075 - DNA, 406 bp, Homo sapiens
tcgaattcaagcttctaacgatgtacggggacatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56076 - DNA, 414 bp, Homo sapiens
  misc_feature (9)..(9): n is a, c, g, or t
  misc_feature (350)..(351): n is a, c, g, or t
  misc_feature (364)..(364): n is a, c, g, or t
  misc_feature (375)..(375): n is a, c, g, or t
ctgcagganttcggcacgaggacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaatagtagaccanncccctgacctggnccagtcgcctnaagcctcgcccctcgtattaagtcgccgattagattaac

SEQ ID NO: 56077 - DNA, 1646 bp, Homo sapiens
ttccaattctacacattgtgtacagaccgacttttttttttttaaatggagggaaagacagtaggacaagaacatcagaatagaagagagtacagtgtagaaattggacatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56078 - DNA, 511 bp, Homo sapiens
gcctgcggccgctactactactactaaattcgcggccgcgtcgacactggagacgcgttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttttttacatgaaggcaatttattaacagaaaatatgtcgacgcggccgcgaat

SEQ ID NO: 56079 - DNA, 247 bp, Homo sapiens
gcctgcggccgctactactactactaaattcgcggccgcgtcgacactggagacgcggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56080 - DNA, 331 bp, Homo sapiens
  misc_feature (192)..(192): n is a, c, g, or t
  misc_feature (208)..(208): n is a, c, g, or t
  misc_feature (217)..(217): n is a, c, g, or t
  misc_feature (220)..(220): n is a, c, g, or t
  misc_feature (239)..(240): n is a, c, g, or t
  misc_feature (264)..(264): n is a, c, g, or t
  misc_feature (269)..(269): n is a, c, g, or t
  misc_feature (274)..(274): n is a, c, g, or t
gatccaaagaattcggcacgaggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaancatctgccgttgactnggggatganggnaaggagaccagatgatccnnaccatatctgcattgtggctccangagtngccanaggtcaagacttggtatccccccctaaaacaactcggccaagggaaatgccagccct

SEQ ID NO: 56081 - DNA, 418 bp, Homo sapiens
tcctttttctccacattctcaccagcatttgtcattgcctgtcttttgtatagagtccattttaactgggtgagatggtatcacattgtagtttgatatacactactctgatgatgaatgatgttgagcacattttcgtatgcctgtttctcatttgcacatcttgttttgagaaatggctattcaaatattttaccatttttaaattggattatgatatttctttcctatacagcttcttgagctcctcatatactctggttattaatccctcatcaaatgggtagtttgcaaatatttcccacaggatgtcacccccatcccctctgacagcactcgcaggaaggggggtcgccgtggtcgccgtctgtgaacaagattcctcaaaatattttctgttaataaattgccttcatgt

SEQ ID NO: 56082 - DNA, 173 bp, Homo sapiens
caggagtcttagtcctatttcctcttgctggcccggagtttgatgtgtagggcggtgatgaggatgtcacccccatcccctctgacagcactcgcaggaaggggggtcgccgtggtcgccgtctgtgaacaagattcctcaaaatattttctgttaataaattgccttcatgt

SEQ ID NO: 56083 - DNA, 171 bp, Homo sapiens
taaaaaacaaagatcagttaaattttattgggagccggggtggaggtcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56084 - DNA, 228 bp, Homo sapiens
caggagtcttagtcctatttcctcttgctggcccggagtttgatgtgtagggcggtgatgaggatgtcacccccatcccctctgacagcactcgcaggaaggggggtcgccgtggtcgccgtctgtgaacaagattcctcaaaatattttctgttaataaattgccttcatgtaaacaaaaacaaaaaaagtcgaccggccgctaatttagtagtagtaggcggccgc

SEQ ID NO: 56085 - DNA, 2372 bp, Homo sapiens
cccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56086 - DNA, 2169 bp, Homo sapiens
gcctgcggccgctactactactactaaattcgcggccgcgtcgacactggagacgcgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56087 - DNA, 2155 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56088 - DNA, 2158 bp, Homo sapiens
aattacggctaggtacgaggctgggtggtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56089 - DNA, 2171 bp, Homo sapiens
cacgcgtcgccacgcgtcgcggacgcgtgggtcgacccacgcgtcggctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56090 - DNA, 2148 bp, Homo sapiens
agacgacagaagggccccgggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56091 - DNA, 2378 bp, Homo sapiens
  misc_feature (251)..(251): n is a, c, g, or t
cggtcctcaggtcctccatgtgtgccacatgcctccccctaaagggtacagggtctgcggaaatcgcgcattccacaaaggcggcccgttcatggagttggtttccattctttaccgcgatccccaactgtttgtgtagaccagtcatccgaggaccagacatcacagaaacttggctttcttgaagaagtgtatcttttgaatttgtgggggcttattcgtttgaccacccttaggagttcttgggggtngatctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56092 - DNA, 2137 bp, Homo sapiens
tagttctagatcgcgatctagaacttgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56093 - DNA, 2136 bp, Homo sapiens
  misc_feature (9)..(9): n is a, c, g, or t
ctgcagganttcggcacgaggacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56094 - DNA, 2156 bp, Homo sapiens
  misc_feature (6)..(6): n is a, c, g, or t
  misc_feature (8)..(8): n is a, c, g, or t
  misc_feature (26)..(26): n is a, c, g, or t
aaaccntnggctaggtacgaggctgngtggtgctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56095 - DNA, 768 bp, Homo sapiens
cccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56096 - DNA, 1666 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaggcgagatagttctctcggcttcgccggtaatcccaacacttggggaggccaggacagatcactggaggtcaggagttcgagaccagcccagccaacatggcgaaaccatgtctctactaaaaatacaaaccttttggggacgcctgctgtagtcccagctactcgggaggctgaggcaggaggatcgttgaacccaggaagtgagactgcggtgagccgatatcggcacccacagggctcagcctggtcgacgggagggagaactccatctcaaggaaaacattaacacttaagtggtctcgaagaagcaatgtctcatccagttaggggcacactcggcggcgataggggggtcagtcaaattgggtcacccatatcacagaccacagctctactaggcgagccacacgtttttcaattaagaaaggccctggggcgcgaataaagggcattcttcatctggcgacggcagggctacgtagggaggaccttgggcagtaaacgaagctgtagtag

SEQ ID NO: 56097 - DNA, 1334 bp, Homo sapiens
  misc_feature (1222)..(1222): n is a, c, g, or t
  misc_feature (1245)..(1245): n is a, c, g, or t
  misc_feature (1253)..(1253): n is a, c, g, or t
  misc_feature (1256)..(1256): n is a, c, g, or t
  misc_feature (1258)..(1258): n is a, c, g, or t
  misc_feature (1260)..(1260): n is a, c, g, or t
  misc_feature (1272)..(1272): n is a, c, g, or t
  misc_feature (1274)..(1274): n is a, c, g, or t
  misc_feature (1288)..(1288): n is a, c, g, or t
  misc_feature (1303)..(1303): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaacaaaaaaaaaaaaaaaaaaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56098 - DNA, 1281 bp, Homo sapiens
  misc_feature (1154)..(1154): n is a, c, g, or t
  misc_feature (1168)..(1169): n is a, c, g, or t
  misc_feature (1189)..(1189): n is a, c, g, or t
  misc_feature (1191)..(1191): n is a, c, g, or t
  misc_feature (1220)..(1220): n is a, c, g, or t
  misc_feature (1224)..(1224): n is a, c, g, or t
  misc_feature (1227)..(1228): n is a, c, g, or t
  misc_feature (1231)..(1231): n is a, c, g, or t
  misc_feature (1234)..(1234): n is a, c, g, or t
  misc_feature (1237)..(1237): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaacaaaaaaaaaaaccncgggccgaattcgnnacaggcccaaaagaaggggngntccagaagccctaggtcccagggtccgcncaanggnnggncanaangggggccgggcgagcattccttcaaggaacgacccgggggagac

SEQ ID NO: 56099 - DNA, 1160 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtagcggacgagcattccgctgatgggggct

SEQ ID NO: 56100 - DNA, 1346 bp, Homo sapiens
  misc_feature (1234)..(1234): n is a, c, g, or t
  misc_feature (1257)..(1257): n is a, c, g, or t
  misc_feature (1265)..(1265): n is a, c, g, or t
  misc_feature (1268)..(1268): n is a, c, g, or t
  misc_feature (1270)..(1270): n is a, c, g, or t
  misc_feature (1272)..(1272): n is a, c, g, or t
  misc_feature (1284)..(1284): n is a, c, g, or t
  misc_feature (1286)..(1286): n is a, c, g, or t
  misc_feature (1300)..(1300): n is a, c, g, or t
  misc_feature (1315)..(1315): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56101 - DNA, 1537 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttaaaacaacaaaaaaaaaaaaaaaaaaaaaaaaaaaaaaaataaaaaaaagagaggggcgcgcgcgcgccctcaaaatattatccccgcgggggggcccccaagttaaggcgttacccaggttttctgtgtgacacaaggggggcccccaaatagtagggaggaggcgttatttataacagcctgggacggtggccgcggggttttaacacaagcgttctggacgtcgtggtggaaacacttgcgtacccatggagagcacctttgtggaagagaaggacaccctcaatccctgggaggagagagaacaacatcttgcggccacaagtaccctaatagagaagatttatagagcccctatgagggcgaaacctaaaaaaatctcaaacagcggttataaggggcac

SEQ ID NO: 56102 - DNA, 1385 bp, Homo sapiens
  misc_feature (1273)..(1273): n is a, c, g, or t
  misc_feature (1296)..(1296): n is a, c, g, or t
  misc_feature (1304)..(1304): n is a, c, g, or t
  misc_feature (1307)..(1307): n is a, c, g, or t
  misc_feature (1309)..(1309): n is a, c, g, or t
  misc_feature (1311)..(1311): n is a, c, g, or t
  misc_feature (1323)..(1323): n is a, c, g, or t
  misc_feature (1325)..(1325): n is a, c, g, or t
  misc_feature (1339)..(1339): n is a, c, g, or t
  misc_feature (1354)..(1354): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacaaaaaaaaaaaaaaaaaaaaaaaaaaaaaaaaaaaaaaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56103 - DNA, 1240 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacatgacgaacttcttgctttaactctaggtggtgccaggtacctaattcggcctatagtgagacgaattacaattcactggccctcgctttacaacgtcgtgactgtg

SEQ ID NO: 56104 - DNA, 3992 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagacagggtctggctctgttgcgtgggctggaattcagtggcacaatctcagctcactgtaaatttcgcctcgtgggcggatctgtccaaaggatcctcccacctgcatctactgagtagctgggacaacagtgtgtgccacaccgggctttttttttttgtagcggggagtttcaccatgttgcccaggttggtcccaaactcctggcctcaggcgttccaccagcctcagtctcccaaagcccaaagtgctaggattacaggcatgagccaccggcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56105 - DNA, 2388 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagacagggtctggctctgttgcgtgggctggaattcagtggcacaatctcagctcactgtaaatttcgcctcgtgggcggatctgtccaaaggatcctcccacctgcatctactgagtagctgggacaacagtgtgtgccacaccgggctttttttttttgtagcggggagtttcaccatgttgcccaggttggtcccaaactcctggcctcaggcgttccaccagcctcagtctcccaaagcccaaagtgctaggattacaggcatgagccaccggcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgt

SEQ ID NO: 56106 - DNA, 1948 bp, Homo sapiens
  misc_feature (1645)..(1645): n is a, c, g, or t
  misc_feature (1660)..(1660): n is a, c, g, or t
  misc_feature (1665)..(1666): n is a, c, g, or t
  misc_feature (1715)..(1715): n is a, c, g, or t
  misc_feature (1728)..(1728): n is a, c, g, or t
  misc_feature (1836)..(1836): n is a, c, g, or t
  misc_feature (1859)..(1859): n is a, c, g, or t
  misc_feature (1867)..(1867): n is a, c, g, or t
  misc_feature (1870)..(1870): n is a, c, g, or t
  misc_feature (1872)..(1872): n is a, c, g, or t
  misc_feature (1874)..(1874): n is a, c, g, or t
  misc_feature (1886)..(1886): n is a, c, g, or t
  misc_feature (1888)..(1888): n is a, c, g, or t
  misc_feature (1902)..(1902): n is a, c, g, or t
  misc_feature (1917)..(1917): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagaccctgtctgaaagaaagagagaaagaaagaaagaanagagagagaaagaanagaanngaaagaaaagggaaagatggaaggaaggaaggaaaaagaaagagaaagngagagagataggngagggaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56107 - DNA, 1090 bp, Homo sapiens
  misc_feature (1058)..(1058): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgtaagggttgtcaacccccattccccttttgacagcaattngcagggaagggggggttcgcccttggttcgcc

SEQ ID NO: 56108 - DNA, 2104 bp, Homo sapiens
aattacggctaggtacgaggctgggtggtggagtctggagacgacgtgcagaaatggcacctcgaaaggggaagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56109 - DNA, 1303 bp, Homo sapiens
cccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaggcgagatagttctctcggcttcgccggtaatcccaacacttggggaggccaggacagatcactggaggtcaggagttcgagaccagcccagccaacatggcgaaaccatgtctctactaaaaatacaaaccttttggggacgcctgctgtagtcccagctactcgggaggctgaggcaggaggatcgttgaacccaggaagtgagactgcggtgagccgatatcggcacccacagggctcagcctggtcgacgggagggagaactccatctcaaggaaaacattaacacttaagtggtctcgaagaagcaatgtctcatccagttaggggcacactcggcggcgataggggggtcagtcaaattgggtcacccatatcacagaccacagctctactaggcgagccacacgtttttcaattaagaaaggccctggggcgcgaataaagggcattcttcatctggcgacggcagggctacgtagggaggaccttgggcagtaaacgaagctgtagtag

SEQ ID NO: 56110 - DNA, 2062 bp, Homo sapiens
gcctgcggccgctactactactactaaattcgcggccgcgtcgacactggagacgcgttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56111 - DNA, 2777 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56112 - DNA, 1028 bp, Homo sapiens
  misc_feature (251)..(251): n is a, c, g, or t
  misc_feature (916)..(916): n is a, c, g, or t
  misc_feature (939)..(939): n is a, c, g, or t
  misc_feature (947)..(947): n is a, c, g, or t
  misc_feature (950)..(950): n is a, c, g, or t
  misc_feature (952)..(952): n is a, c, g, or t
  misc_feature (954)..(954): n is a, c, g, or t
  misc_feature (966)..(966): n is a, c, g, or t
  misc_feature (968)..(968): n is a, c, g, or t
  misc_feature (982)..(982): n is a, c, g, or t
  misc_feature (997)..(997): n is a, c, g, or t
cggtcctcaggtcctccatgtgtgccacatgcctccccctaaagggtacagggtctgcggaaatcgcgcattccacaaaggcggcccgttcatggagttggtttccattctttaccgcgatccccaactgtttgtgtagaccagtcatccgaggaccagacatcacagaaacttggctttcttgaagaagtgtatcttttgaatttgtgggggcttattcgtttgaccacccttaggagttcttgggggtngatctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacaaaaaaaaaaaaaaaaaaaaaaaaaaaaaaaaaaaaaaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56113 - DNA, 963 bp, Homo sapiens
gcgacaagacgacagaaggggctctcccgggtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttaaaacaacaaaaaaaaaaaaaaaaaaaaaaaaaaaaaaaataaaaaaaagagaggggcgcgcgcgcgccctcaaaatattatccccgcgggggggcccccaagttaaggcgttacccaggttttctgtgtgacacaaggggggcccccaaatagtagggaggaggcgttatttataacagcctgggacggtggccgcggggttttaacacaagcgttctggacgtcgtggtggaaacacttgcgtacccatggagagcacctttgtggaagagaaggacaccctcaatccctgggaggagagagaacaacatcttgcggccacaagtaccctaatagagaagatttatagagcccctatgagggcgaaacctaaaaaaatctcaaacagcggttataaggggcac

SEQ ID NO: 56114 - DNA, 1013 bp, Homo sapiens
  misc_feature (949)..(950): n is a, c, g, or t
  misc_feature (963)..(963): n is a, c, g, or t
  misc_feature (974)..(974): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaatagtagaccanncccctgacctggnccagtcgcctnaagcctcgcccctcgtattaagtcgccgattagattaac

SEQ ID NO: 56115 - DNA, 2244 bp, Homo sapiens
gtcccgtgccatagcttgacatgcctcgccaggtccgaactcctagaggactcccctggtggtcctactggtaggtagctccctccctccctccttgtagcgaaggctcttctccctgatctcccctgagctgaactcactatgaagtgcacctccgtaggggatattaatgccttctcctcatagcggattcttatgtagttactctccaactcgagaacgagctacttactagacaggttccgtgtttacctttttcctgtccatgtcaccgatctttctggccaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56116 - DNA, 1173 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56117 - DNA, 3283 bp, Homo sapiens
  misc_feature (1)..(1): n is a, c, g, or t
ngagcgcagaatctctctagaaaaagattggactagatcttgaaataccctccatgactacagggttgcctgccaaccagagcatattgactccaacctttactgaaatggagctgtgactttgctggggagccggtcgcggcgcaccgccgcggtggaaatgcgcccgtcggcggccggtcgccggtcgggggacggtccaccgccctcgtgccgaattcggcacgaggaggaccaagacccctggacctggggcccagtcggccctcagagcccttgcccgctcgggtatgaagatcgggcggattgggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttgatatgaatgtcctgtttcatttgtgaatctctgtcctacactgcctggtgcaggtaaaactgacaagagatgaattgtcctttcctccattcttgaggtcattgctattagcattttgtgtgtaccatctcctgcattgtaggatgttcagcatttttggtttccgcctactaaatatcagttgggcatgccagtcgtgtgacagccaaaaatgaagtggggggtaccagcttctgttattaataccctcaggcctgtgatctcctggctccttacagctcttaggaagggaacagtagtctttccctgcacattgttctgtgcagttagtagcgacatacactgacgccccaggccaaagttcctactgtgtcctacttgaaggatgattttgttttcttgagacagggtctggctctgttgcgtgggctggaattcagtggcacaatctcagctcactgtaaatttcgcctcgtgggcggatctgtccaaaggatcctcccacctgcatctactgagtagctgggacaacagtgtgtgccacaccgggctttttttttttgtagcggggagtttcaccatgttgcccaggttggtcccaaactcctggcctcaggcgttccaccagcctcagtctcccaaagcccaaagtgctaggattacaggcatgagccaccggcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56118 - DNA, 1120 bp, Homo sapiens
  misc_feature (993)..(993): n is a, c, g, or t
  misc_feature (998)..(998): n is a, c, g, or t
  misc_feature (1017)..(1017): n is a, c, g, or t
  misc_feature (1029)..(1029): n is a, c, g, or t
  misc_feature (1031)..(1034): n is a, c, g, or t
  misc_feature (1037)..(1037): n is a, c, g, or t
  misc_feature (1042)..(1043): n is a, c, g, or t
  misc_feature (1046)..(1046): n is a, c, g, or t
  misc_feature (1050)..(1050): n is a, c, g, or t
  misc_feature (1059)..(1060): n is a, c, g, or t
  misc_feature (1063)..(1063): n is a, c, g, or t
  misc_feature (1069)..(1069): n is a, c, g, or t
  misc_feature (1071)..(1071): n is a, c, g, or t
  misc_feature (1075)..(1075): n is a, c, g, or t
  misc_feature (1080)..(1080): n is a, c, g, or t
  misc_feature (1088)..(1088): n is a, c, g, or t
  misc_feature (1096)..(1096): n is a, c, g, or t
  misc_feature (1098)..(1098): n is a, c, g, or t
  misc_feature (1114)..(1114): n is a, c, g, or t
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaatagaaagaggaanagacnaaacctggactgggccatngcctaaaccttncnnnnggntgaannggngatnagattaccnnccnttaaantnagangggtncgtgtccntttaaaantntaaaatttttaaaatncttttt

SEQ ID NO: 56119 - DNA, 935 bp, Homo sapiens
cccactctctctttccggtgtggagtctggagacgacgtgcagtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccagaaccggggatgggatcctctagatca

SEQ ID NO: 56120 - DNA, 555 bp, Homo sapiens
  misc_feature (443)..(443): n is a, c, g, or t
  misc_feature (466)..(466): n is a, c, g, or t
  misc_feature (474)..(474): n is a, c, g, or t
  misc_feature (477)..(477): n is a, c, g, or t
  misc_feature (479)..(479): n is a, c, g, or t
  misc_feature (481)..(481): n is a, c, g, or t
  misc_feature (493)..(493): n is a, c, g, or t
  misc_feature (495)..(495): n is a, c, g, or t
  misc_feature (509)..(509): n is a, c, g, or t
  misc_feature (524)..(524): n is a, c, g, or t
gcctgcggccgctactactactactaaattcgcggccgcgtcgacactggagacgcgtgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56121 - DNA, 794 bp, Homo sapiens
gtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaagggtgagtgcgggtccagccttttaaggcctcggccccgcaatacggccacggccacggccgcgtttgagctgcacagcgtagttgagggaacccgggacagacgtgggctcccgcctctacctcgccaaacttttttcttggtgatcgcaggcccacgcctaatctcgtttgtttcctcgtttgcaaaataggaataacaatagcaccgatcccatgggtttgtagtgatcattcaaagaaggaaagcagggaaaactctcgcactatgttggatgcttctaaatctgggcgattctttccgttgctgagtcgggcacgttgcaagttctgggcgctcagggcccagcaccaatgtttgctgtgcgcttgccctgcgtttatatactcctgatgaccactctgctcgttactttaggggatgttaggaacggagaaactgcaaattggcatttactgaatggccatcatgccgaaacatactcatgcttacgtatttgagatatgctggagcctttctatgcttctcgaggcagaactttgggcttctctcctg

SEQ ID NO: 56122 - DNA, 633 bp, Homo sapiens
  misc_feature (1)..(1): n is a, c, g, or t
ngagcgcagaatctctctagaaaaagattggactagatcttgaaataccctccatgactacagggttgcctgccaaccagagcatattgactccaacctttactgaaatggagctgtgactttgctggggagccggtcgcggcgcaccgccgcggtggaaatgcgcccgtcggcggccggtcgccggtcgggggacggtccaccgccctcgtgccgaattcggcacgaggagttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56123 - DNA, 498 bp, Homo sapiens
gcttagtattactgtaagcggtcgcggatcgattgcaccctcggaacacgtgcaaatggacctaagggaaaggaagaacgttcctcggacctcaggtgtggaaatttttggtctgccattgcatcttcatgacacttttcgtacgatctttggcaaggaaaccatctcggtgactggggatggtaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56124 - DNA, 2994 bp, Homo sapiens
cccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttaacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaaaaaaagcttgcaaaaaaaatataacagtactccttaaattgttaaaagtcatgaaagtcaaggacaggagattaaggaggcgtgaaaactaaatgcccattgtggtatcctggattggattctggaaccagaatagggtattagtataaaaactagtgaaataggataaaggcagggcacagtggttcacgcctataatcccaacactttgggaagccgagacaggaggacggattgagcccaggagtttgagaccagcctgggcaacacagggagaccccgtctctacaaaaaataaaaaattagctgggcatggtggcacacgtctgtactgccagctacttgggaggctgaggtgggagaattgcctgagcctgggaagtggaggccgcagtgagctgtgattgcatcactacattcagcctgggtcacagagcaagatcctatctcaaaaactaaataagtaaataataaattaaaaaatatgaataaagtctggagttaaagtctggaataaagctagtagtaatg

SEQ ID NO: 56125 - DNA, 621 bp, Homo sapiens
  misc_feature (509)..(509): n is a, c, g, or t
  misc_feature (532)..(532): n is a, c, g, or t
  misc_feature (540)..(540): n is a, c, g, or t
  misc_feature (543)..(543): n is a, c, g, or t
  misc_feature (545)..(545): n is a, c, g, or t
  misc_feature (547)..(547): n is a, c, g, or t
  misc_feature (559)..(559): n is a, c, g, or t
  misc_feature (561)..(561): n is a, c, g, or t
  misc_feature (575)..(575): n is a, c, g, or t
  misc_feature (590)..(590): n is a, c, g, or t
tcgaattcaagcttctaacgatgtacggggacatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaagaaaaaaaaaaaaagaaaaaacaaaaaaaaaaaaaaaaaaggggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56126 - DNA, 634 bp, Homo sapiens
tgggccaaggtggaaggagtgggttccccccccactccacccgccccccccatgcgaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaggtgtgtgcgggcgcgcgcccggggccccgcggaaagagagtttttagaaaccttgcgggtgggggcgcgcgggggccccagggtggaagagggaacaacgtggggcgcaaagcgggggggccctcaaggagagagaccgcggggaccagagagacaaagggcggtgggggttctccacaccacaatataaaaaaaccgcgcccgggggggcgacaccgcgacgagcggcgtcttggagaacaaaaatctccagagagggggggcccaggggggggaacactaaaggggggagctctctatcaacaggggaggcgtcccaaggaaaacgccccgaaatctcaaaattaaacgcccccggcgccgggggggc

SEQ ID NO: 56127 - DNA, 1184 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttttttacatgaaggcaatttattaacagaaaatatgtcgacgcggccgcgaat

SEQ ID NO: 56128 - DNA, 1195 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtcaaccctcatttttttagggtaacagatttacaccccatgagaataagggctcctggtcccccg

SEQ ID NO: 56129 - DNA, 1470 bp, Homo sapiens
  misc_feature (1178)..(1178): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaataaaaaaaagacaaaaaaaaaaaaaacnggggggggggggaaaaacccggggaggtttccagggttcgcggaccccagcggcgcggatggtggaaatcctcccttgaagggagtcctaatagcatcgttcgcacaagaaaaggaggggtcaccccagggcacatcacaggcaagccgaccaggcggtcctaagctgaagccgggggggcacagtgaaattccagggctcccccatgtggtaatacgggccgggcccggggggccgaagcctacacctgaaaaccagggcgggcatcacagggcacacttcgcgaatcacc

SEQ ID NO: 56130 - DNA, 1315 bp, Homo sapiens
  misc_feature (1203)..(1203): n is a, c, g, or t
  misc_feature (1226)..(1226): n is a, c, g, or t
  misc_feature (1234)..(1234): n is a, c, g, or t
  misc_feature (1237)..(1237): n is a, c, g, or t
  misc_feature (1239)..(1239): n is a, c, g, or t
  misc_feature (1241)..(1241): n is a, c, g, or t
  misc_feature (1253)..(1253): n is a, c, g, or t
  misc_feature (1255)..(1255): n is a, c, g, or t
  misc_feature (1269)..(1269): n is a, c, g, or t
  misc_feature (1284)..(1284): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaacaaaaaaaaaaaaattcggggggataaatggggggggggggaaaaagggggtatggaacgggnccatgggccaaaaggcggttccnggacccangtntntntggtccaagggngnaaatcggcagggtncccaatagggagcgnaataatggcggaaagccgagttaccggataa

SEQ ID NO: 56131 - DNA, 1441 bp, Homo sapiens
  misc_feature (1149)..(1149): n is a, c, g, or t
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtacaaaaaaaaaaaaaacnggggggggggggaaaaacccggggaggtttccagggttcgcggaccccagcggcgcggatggtggaaatcctcccttgaagggagtcctaatagcatcgttcgcacaagaaaaggaggggtcaccccagggcacatcacaggcaagccgaccaggcggtcctaagctgaagccgggggggcacagtgaaattccagggctcccccatgtggtaatacgggccgggcccggggggccgaagcctacacctgaaaaccagggcgggcatcacagggcacacttcgcgaatcacc

SEQ ID NO: 56132 - DNA, 1520 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaggtgtgtgcgggcgcgcgcccggggccccgcggaaagagagtttttagaaaccttgcgggtgggggcgcgcgggggccccagggtggaagagggaacaacgtggggcgcaaagcgggggggccctcaaggagagagaccgcggggaccagagagacaaagggcggtgggggttctccacaccacaatataaaaaaaccgcgcccgggggggcgacaccgcgacgagcggcgtcttggagaacaaaaatctccagagagggggggcccaggggggggaacactaaaggggggagctctctatcaacaggggaggcgtcccaaggaaaacgccccgaaatctcaaaattaaacgcccccggcgccgggggggc

SEQ ID NO: 56133 - DNA, 1414 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaagcgtcctcgtggaatgtgacatcgtttttaaaccctgcgtggcaatccctgacgcaccgcgtgaatgcccagggaagacaggacgacctggaagtccaactacttccttaagatcatccaacctatgggatgatatccgaaacgttcattgtgggagccagacaatgtggggctccagcaaaggcagcagatcgatgtccttcgaggaagctggggggcgaagggagaaaacagagagggcaggcacgggggcggaaaaccacctggaagggccac

SEQ ID NO: 56134 - DNA, 1131 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgt

SEQ ID NO: 56135 - DNA, 959 bp, Homo sapiens
gctcggcgtgggcctggcaggtggagacttgatgctggcaggaggggcgttagaatcctcacctacctaagcctgtggtggagcaaacagccctgcgggactcaatgcgtgtaacccttggattttcacccaacagttctgcaagtctctttcctcaaataaaccatcccccatctgcataatatggaagctaagtagatcgcccacaaagaaaagagaacaatcctgtataaaatgaggaagccagactaaataattccaaagtgtctttaggcaaatgcagaccagaatacagcatacttgaagatggatccttctagacccactccttctgcttgtctggaaagcccaggcctgccagcatcagcggcgacatttcaattctgccagtttgatcagaccacgtggattttctctctccaatacaccagctgataatgaagagacaaatgttagctaaggcagccctggtcaatcccaaagtccttagatgcaaaagacagggaaggtgctaatcatctcaggaggagaccccagacgggctcattaaaaccattataagaaatccctatctcccccaccacacctccaaggaaaccctgaccctggtgagtgagcagggattgcaggggcttcccttgcaccagttcttttggcttaggagggaggacatggcccagctcacccaccacctgcagcagcaacagcagcagccattacctttgaaataatcctcgctcgcacaccaagtatttgttatgagtctgtgcctggaagtaaatatcacttctgtttaggtgaccatgtgtcctgggtttcccaggacagtctggtttatgcctgttgtgctgacacacatatgattagtacctactgccatgctgaaaagcgtcttgtttgggcagtaatgtatgtggttacctaagctctaccaagttgtttcaaaactgattggaggg

SEQ ID NO: 56136 - DNA, 195 bp, Homo sapiens
ggaccagggagggagttattgtttaatgagtgtagagtttcagttttgcaaggtgaaaagagttccggagatagaggatggtgacagtgatagaacaatgtgaatgtaattaataccactgaattttatacttaaaaatggttaaggtgataaattttacattatgtgtgttttaccacaaaaaaagaattagct

SEQ ID NO: 56137 - DNA, 350 bp, Homo sapiens
gtaccttttctgcagttggaagatgggaaattctattaggagcctcagtgagttgggtagaagtcacaccaatcaacggaattaattctagaagattgtggtggaagacattatattaatgattccaagagaccctgatgttggcttctgaaaaatttaacatcttcattgtaaagggaagggtgagaatgtccccaagaagctatgccatgactcagtggcctctttgaaagattctcattttaatctaaatagtgtgacttcagtgaaggtcaacatggtcccagttttaagaggatcccaggcattagccactctggcaccaccacctggcactggttatgattatt

SEQ ID NO: 56138 - DNA, 419 bp, Homo sapiens
ctaaatttgatgaactcaacctcctatcaactggaactgttactctgtcacttggtgcatgactacaaagatagttctgacttcatgtttataataatgatccccaatgctgcaagatcctgaagtgcctttgagtcatcaccaataacttactcatcagaattgctttcgtgttgagtagattttgctgatatctgattgttcagcaagtacaaacttaattaagcttctattttagtactagatacatgctctaagatcaagacagaattccctataaacagaatatttgctagatcatatcccattatttgagcaaactggatccagaatattttcttgtttgtttgtaaagtagttcatgtgtacatttgtgtgtgtgtttgtaaatccttcctttcttggtgaattttctttta

SEQ ID NO: 56139 - DNA, 306 bp, Homo sapiens
ctttttttaaaaatttctaatataatacttttgtaaaatgataaagatgaagacatgcatacaatatgtaagcctgaatttgattagtttcagcagatacaaaattgtcaaattgctacagattttcaaagtgtttactttgcatttctatacttaacctcactgtcaaccataaccagtttgtggaccagcagtagtagtctgtggactatactttgagttactggttcaaaccattattagtgccaagagggactactgattattccatacttcaaataaggtgttgggtgatttgtcttaacc

SEQ ID NO: 56140 - DNA, 2736 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56141 - DNA, 776 bp, Homo sapiens
tccggggatatctttcgccgggtggtcggatcctcacggctggtccggcatggcatgcagtagcagctgatcttttaggaggaagagtaaggaaaaggcgtgggttttggaggtgggcacttcaccccgaacttttattctgctacaccctcaagcaagggatcacatatctgatcctgcctcaccctcaggtaagaaggaaatagggggagaggctcagctaagcctcccaacttcttccttctccctcagtctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagaggtcagtttgggagccatcccttctgggtgcgtcttaccccgcagagctgccttctccacgggcctccggccacacctcctttacaggcacagttgcccctgctcccaagggctctttccagcccagactgccaggttgagaggagacagggttaccttcgtgatctctctgt

SEQ ID NO: 56142 - DNA, 481 bp, Homo sapiens
agagggtcagcccagctatctgtgggagcttgatgctgtaaacttagaaaagacctaggtttgaatcctgggctctgccactgactagttatgtgaccttgggaaagccacatcacttctttaagccttagtttcctcaactgaaaatgaggtaattgtgagcattaaaaaagttggtgcaagaaaagtgcttcagatggtgcatgcacatactataaaatgcaataaaaaatatctattatgattactgttgctgttagacctgggccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56143 - DNA, 2747 bp, Homo sapiens
ccccgctgcggccgcgtctgcctggcccgtcccctccagcccagctcgggctccagctccagcgccggcgcttcagctgcgaccgcgagccctctcaagcaagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56144 - DNA, 2647 bp, Homo sapiens
ccccgctgcggccgcgtctgcctggcccgtcccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56145 - DNA, 2824 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccacaataaaaaccaaaaaataattgaggcccactgataatgatgggttcccttgggattgtaaaaaaaaaggggggcaagttccaagggcatagggacgtttgaagggcaaggggtaaagagaggggacaggggaaggtgttggggcctgggtgcgcccaaacggaaggggctggtagaaac

SEQ ID NO: 56146 - DNA, 2608 bp, Homo sapiens
gtggctgttctagaggtcccggtgctgtgctgggtcgggaaggaggagcgtgacagctggagcggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56147 - DNA, 2879 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56148 - DNA, 2697 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctcatgcgcacacacatacacacaccccaaaacacatacattgaaagtgcctcatctgaataaaatgacttgtgtttcccctttgggatctgctaagtaagtggtacacttccttcttttataccttcactccttaaatgacgtagattctcccaagaagcaacagaaaaaccagca

SEQ ID NO: 56149 - DNA, 2685 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacacgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56150 - DNA, 2971 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacagtgagtattgacgatcccagccaaaaattaaacccttgggctccatggatcctaaatccccattccacagcttctttacacccttctgatgcctgaacttcccctgcacatcattcatcctaaaccctgatttctcagcccctggtttccctatcgtggcctctctaggaacctagcaacccaccccaaaccccacagatttccctctaaatctctgaagccacagccccaaagtatcaggtcctgcctctgaatgtgctcccttcccttccagatcaagatcacccacaagaaccagatgcccatgctcatgggcccacccccccgctccaccaatttctttggcttcttgagctaagggggacacccttggcctccaagccagccttgaacccacctcatgcgcacacacatacacacaccccaaaacacatacattgaaagtgcctcatctgaataaaatgacttgtgtttcccctttgggatctgctaagtaagtggtacacttccttcttttataccttcactccttaaatgacgtagattctcccaagaagcaacagaaaaaccagca

SEQ ID NO: 56151 - DNA, 1541 bp, Homo sapiens
ctcaaaagtttaaacctcccccacggagtatggtagcgaggctggggctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56152 - DNA, 1506 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagaggtcagtttgggagccatcccttctgggtgcgtcttaccccgcagagctgccttctccacgggcctccggccacacctcctttacaggcacagttgcccctgctcccaagggctctttccagcccagactgccaggttgagaggagacagggttaccttcgtgatctctctgt

SEQ ID NO: 56153 - DNA, 715 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagtgagttggggaccctgtatgctgggcaagggaatatgtgtta

SEQ ID NO: 56154 - DNA, 246 bp, Homo sapiens
ttgctccagctctcagagaagaggagtaaagagtggtactgttttggaggatctgaaatatttttccctctgtatttctgtgtttcttcttggaatttcttcatctcatttgaatcttttttcctgctggatttctctggcaagagaactcagctggactaataatgctgttctcttactctctctacaccctagactccaccaaaaaggtcagtgatgtcctaaagctcttcgaggatggcgaga

SEQ ID NO: 56155 - DNA, 262 bp, Homo sapiens
ggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggtcagtggaatggggcctggggagaagggagaaagggggggccaagcagtcagaggctggaggagagcagaaaaggagggggaggttaagtgacctgtgacacagggaaattgggagtgc

SEQ ID NO: 56156 - DNA, 185 bp, Homo sapiens
ctgccaggttgagaggagacagggttaccttcgtgatctctctgtgcccacctcgtctttcagatccacgatgactgcctgcaagcggtgggccatgagtgtgactgtgggctgctccgggatcacatcctgcctccatcttccatctatcccagtgtcctggtgagaccctcggcagcagcggg

SEQ ID NO: 56157 - DNA, 481 bp, Homo sapiens
ccccgctgcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggtatcgagaagggtctgcgctgggacgcgggggtgcagcgggagggctgggcccgaacccggtgggtaacgtttcccagaccttcccctccatccctcccgctcattcggagggatggtgaagcccggttcctgggacccgactcggagggaagtcctcttcggaacctccacagtgccgcacgggtggagaagggttcttgtttggcctccaggtccccaacttcccaccccatcctctccccac

SEQ ID NO: 56158 - DNA, 2986 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaaaaaaaaaaaaaataaaaaacaaaaaacaatttgggggggcggactcaggcccgagaaaagttttaaacacaatctggtttgggccggggccacgtaggaaatgacaccagggccatagctggtccaaagaaaccggggcataccaagtgcttggttccccccaataacaacgccggggaacggcgtttgaacaaccaaggggtcggggcaacggaccttaacggggccaggaccagtaacaccggggggc

SEQ ID NO: 56159 - DNA, 2779 bp, Homo sapiens
ccccgctgcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56160 - DNA, 2704 bp, Homo sapiens
ccccgctgcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56161 - DNA, 3010 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacagtgagtattgacgatcccagccaaaaattaaacccttgggctccatggatcctaaatccccattccacagcttctttacacccttctgatgcctgaacttcccctgcacatcattcatcctaaaccctgatttctcagcccctggtttccctatcgtggcctctctaggaacctagcaacccaccccaaaccccacagatttccctctaaatctctgaagccacagccccaaagtatcaggtcctgcctctgaatgtgctcccttcccttccagatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56162 - DNA, 3279 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcaggttagggaaaggagggggcagtgtgggcatacacagtgtcaggagccaggttttgaccaagtttgactcagattgctcagaagaacagtggcacctctaggaggtccccccaaccaaagccacccttgttccccatgggactaaagttaggaggttgatgcccttccctgtcacgtaccacccctgccagcactgtgtaacctgtccctccctactgggccttgtgttggggctgacacagaatgaagaacaagctatggtacttcgaatttgccacatctgaatccatcttctcaacatgcaaaaagctggaggagtctttgacagttgaggtgtgtgtaataagacttaaccctacatccttttcagcttcttaatagccaagtttctccctccatggcacccttaggaacttcccatattcttgaacctatgcttctttaacctcccagctctcctaccccaattctccaagtcctcaagatacactagtccctatttccattccttgcacacctccaaatcctgccttctccagtttgtcatctggtggagggagcgatcacatctatgatcatgccatgaggtgaggatctgtaccctccctaactgggactgtgccccctcctctcagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56163 - DNA, 1329 bp, Homo sapiens
ctgttcgtgaacccgaagtggggggggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56164 - DNA, 1534 bp, Homo sapiens
  misc_feature (27)..(27): n is a, c, g, or t
  misc_feature (39)..(39): n is a, c, g, or t
aaacgagaccaaaatacggctaggtangaggctgggtgngctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 56165 - DNA, 793 bp, Homo sapiens
ggggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaaggtatggtcaagcaggtaggatgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaagtggtacacttccttcttttataccttcactccttaaatgacgtagattctcccaagaagcaacagaaaaaccagca

SEQ ID NO: 56166 - DNA, 1129 bp, Homo sapiens
agtttttaagaattattttaatacacttttcctgcgaaactcaattcaaggcagcttcaaggtaaaaatgcttatatttggcatctgtccttgtatttttaggcaccttgatgcattcacactcactacgctcacacccagaagacccccaagaaatccgcttctttgtgcagataaaggaaatgcaaactggtcattctggaaaccagggtcaattctagatttctagaagcctggctgtgggcctcaaggcctttcatgaaagcaagggcctcagattgaccctttccaagcatcccctaccaggaggggaagggcacagattctcaagggaccgtggtgcatgcaggtaaaccgaaacctctaggctggcacgtggcaccactgccctgggagacaagccatccccgctctctgtctggatggcctggtcaatgcagtgtagatcatggatgtgatttctctcactgatatttgggggatacaatttaaaatgtatccaagtatctgatggaaataagagggagctacagaaaatgactcaagctgaggacatataggaaggaatcggttcaggtgtaaggaaggatttctggggaactttcttccttgtgttcatccctccctctttacataaggtcttgagtcacgagcaccttgtgttagatgctgggctacaaaatgatcaaaacagaaggcctgcccactgagagtacacacttccctgggccacatccaccctccaaagtaatcccaccataacagggcagctgtcatcatggaaggactgcccacgtgcagaggggcccaagaaagtggtcttgtcctcaaagcaacttgagatgaggatcctgtgtcatccaacagctacagcttaggcagatgaatagcggcttccctgggcccaggcagtcctccaattcataaaagcaaacaggcctggggcagtggctcacgctgtaatcccagcactttgggaggcctaggcaggcggatcacaaggtcaggagtttgagaccagcctggccaacatggtgaaaccccgtctgtactaaaaaaaatacaaaaattagccgggcatggtagcatgcgcctgtaatcccagctactcaggaggttgaggcaggag

SEQ ID NO: 56167 - DNA, 204 bp, Homo sapiens
cttttcctctcattcctgtctgtgccttcatttctgtcttgttctcttgctcctccaaggacgacaatgtgcatttattgagtgcctcctgtgtgcccaccacctcaccagtgtacttgttctcatttcctctcttctccctgcctccttctctccaccagcttctccccctcctctctgccctgccagctctttcctgaggga

SEQ ID NO: 56168 - DNA, 667 bp, Homo sapiens
tatacattttaatattaaaagaaaaagctgtgatacataatgattatacatatgtatggggaacattgttcgtttcaatacatggagagattgtgtaatcatcaaatcagagtcattagaatttcatcacctcaaatatttatcagttttttgtggtgaggacatgcaaattattttcctctagctttttttgaaatatacaatatatttccattatctgagaatatgctgtatttagcaaaaaataatttgcgattactaggtacttcagtgcatgtagagagggtattttctcagttaaaagtaatgtattctatggagaccagtcaattgaaggtttcaacaatttcaaatttattagcataaagcacagctttgaaaacaaatgcaggcaattttatgaaaaaatggaaaacaataaaactgtatttcaaaaatacattgtccacaaatagaataataatgaccaatattacttgtacaactaagatggtgtttaaattaaatgaatatataacataaataatcatactacttgttatttaatgtgctgataatcaatacaaatattcttttgcttttatgaatagaaatagatattgctttcttaaagaaacattttatttcaaaaatattttataacacttccataggcccaaaccccact

SEQ ID NO: 56169 - DNA, 333 bp, Homo sapiens
aatttttagaaattatgataaaccaccatttaaatgaataatatgacacagaaaatttactttgctcaccctggagtgttagaaagaaaagttgaatattaatcactcacattagactgtgaagtagaggaataggcttaatagaaaacctcctacattacattatttttattggaacaaatgacatctctctaaatgccttctgacttattctctgtgcttactctcaagatagtacagaaaaagattgctttaaagtgttagtgtcagaggacagattttgaagcataaataataatgttgtaaatagcatgtgtattctgtagctttgag

SEQ ID NO: 56170 - DNA, 299 bp, Homo sapiens
gtggcaggcacttgtaatcccagctactcaggaggctgaggcaggagaattgcttgaagccgggaggcagaggttgccgtgagccaagatcataccactgcactctagcctgggtgatgagctctcaaaaaaaaattaaatggttagtgtttcctggtgtgattgtgccataatttatttacccaggccccagttgactggcatttataatttttccacaccatttctcttacagacaaggttgcagtaaagatcttttacatatttttgtatacatgtgagtatatacctttggaaca

SEQ ID NO: 56171 - DNA, 148 bp, Homo sapiens
acaggatctccaggtaagacttcctttttggaaacttgactgagccaccagaaataggggtagttattaaaagccacaacggcaaggcagccaaagccaggcagttcatgattcaaccagtttgcaaataaagacaccatgagacagg

SEQ ID NO: 56172 - DNA, 438 bp, Homo sapiens
gtccttctcctgtcacaaatccacacaggcacatctccctctaactgtgacttctctcatgcttccctcttccatttttgaagaatttttttttttagacagagttttgctctgtcacccaggctggggtgcagtggcatgatctcggctcactgcaacctctacctcccatgttcaagcgattctcctgcctcagcctcccgagtagctgggattacagtcatccaccaccatgcccggctagcttttgtatttttagcagacttgggatttcaccatgttggccaggctggtctcaaactcctgacttcaagtgacctgcccacttcagcctcccaaagtgctgggattacaggtgtgagcccccatgcccagcctttaaagaacccttttgatgacactgggcctactgcataatccagaataaccttcccatct

SEQ ID NO: 56173 - DNA, 290 bp, Homo sapiens
cgggacgctgactgctctttctcctcaccctggccctttatatacctccaggcagccatggcgaacacatctggctccagaagcccccactgaagctggccttgctctctctcgccatggcctctcactcaggtatcactggtcctggtgcttccggagtcttgggcatcatcttatctcaccaggaagattctggaagcactacccccagggttggctcagcagggctgcagggatggagccagggtgggcaggggtgtgtgatgtatgcgctcacggcatcgttctct

SEQ ID NO: 56174 - DNA, 546 bp, Homo sapiens
gtgtatagctgttccagtggtcactagctgttagcagatgacgatctgtgaatagaaccataatctgttctctcttccaagctgcagcaaggcgtttgccatttccatttctgggatctcttaggctagatgatcagtaatgatgggattgtaggtaggatggctttatctgcctccactactcaatcgataaagactacatctcacttaacaagtctgccagggatttttagacagcctctgttgttgtagttgatgcatctggagggtcagcctttccagctaggtctttcttaacaaaaagtggcaaaagtgttattgcttttttcccctcttttcagatctcatgttcttgtgtggcttcctgcttcagtgctgtttgtgggtataatctatgctgggtccagagcattgtccagactggtaagtattagaggttcaggggaaacaactcctctctccctttcccctttgccttttaacttatcatgcctcagctcaataagggcaaagaatcactttaataatgataataatgggacctat

SEQ ID NO: 56175 - DNA, 1491 bp, Homo sapiens
  misc_feature (21)..(21): n is a, c, g, or t
  misc_feature (30)..(30): n is a, c, g, or t
  misc_feature (33)..(33): n is a, c, g, or t
  misc_feature (1161)..(1161): n is a, c, g, or t
aagatatgctagtacgaggcnggtggtatnggngaggcggcggcagggattgggcaggcaccgtggatccccgggaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcttcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggattttgggattctttctcatgttcagtacagtgaagctaaaaaaccttctggccccagggcagtgtgcagcctggattttcttgctaagataatcacagctggcttatcaatatgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgcatcacctcacccaagtgaatgtggtggtggtgatgaggncgaggcctggtgcttcaaggagcacctttctgggggtctgcaggtcactgcagaggagcggtctgttacatcttcccatttggagaacctctctcaacgtgctgtagctggttctgcagaaaccaggaagtaccaggatttcatgggctggtctggtcgctcgatgagcttcaacttctggatggcaaatgctctttcccaaaaactggtttcagtgaagggaatgggcaagggttggggagtaataccacgtaaaacttaattatttatatattttaaaaaagggcacctggggcagggatgaagggggacacagtgggacgttaacac

SEQ ID NO: 56176 - DNA, 1386 bp, Homo sapiens
  misc_feature (21)..(21): n is a, c, g, or t
  misc_feature (30)..(30): n is a, c, g, or t
  misc_feature (33)..(33): n is a, c, g, or t
  misc_feature (1056)..(1056): n is a, c, g, or t
aagatatgctagtacgaggcnggtggtatnggngaggcggcggcagggattgggcaggcaccgtggatccccgggaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcttcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtggattttgggattctttctcatgttcagtacagtgaagctaaaaaaccttctggccccagggcagtgtgcagcctggattttcttgctaagataatcacagctggcttatcaatatgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgcatcacctcacccaagtgaatgtggtggtggtgatgaggncgaggcctggtgcttcaaggagcacctttctgggggtctgcaggtcactgcagaggagcggtctgttacatcttcccatttggagaacctctctcaacgtgctgtagctggttctgcagaaaccaggaagtaccaggatttcatgggctggtctggtcgctcgatgagcttcaacttctggatggcaaatgctctttcccaaaaactggtttcagtgaagggaatgggcaagggttggggagtaataccacgtaaaacttaattatttatatattttaaaaaagggcacctggggcagggatgaagggggacacagtgggacgttaacac

SEQ ID NO: 56177 - DNA, 478 bp, Homo sapiens
  misc_feature (467)..(467): n is a, c, g, or t
cactgttagctgaagcttcaaggatacaaattcaataatcctctattaacacagctcagaaatgttcagaaatccaggggtgtttctcttttcatgtgcgtcatgtcaaggaagtaaaaccttcctgttaattgtgtccttcataatcatgatgctttccatgcccagcactctggggaccaatggaaggactgactgcgttatcatagaggattattgaatttgtatccttgaagccttccaaatgttgatggtcttctcctgtcagctgggtgtgacactcgtagggaaaaggaccagcagtcgtgcttttgggagcctttatccatgtggattttgtgtgtccccggacaggccagcagctccttgagcagaataccatgaccagtgatatgttttatttcattttcaggggcttataaaattctacagaagtcccagaaacccagtgcattaagtgacattgnccagggggatg

SEQ ID NO: 56178 - DNA, 1328 bp, Homo sapiens
  misc_feature (21)..(21): n is a, c, g, or t
  misc_feature (30)..(30): n is a, c, g, or t
  misc_feature (33)..(33): n is a, c, g, or t
  misc_feature (998)..(998): n is a, c, g, or t
aagatatgctagtacgaggcnggtggtatnggngaggcggcggcagggattgggcaggcaccgtggatccccgggaaggggacgagttgacagatgtgcgtgaggaggtctctggtcggcctcaccttttgtacctgctacctggcttcttacctcacgaacaagtatgtgctgtctgtcttgaaatttacctaccctacattattccaaggatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcttcctcctggccgcagcaggatgccttcccttcaatgactcccaggggcttataaaattctacagaagtcccagaaacccagtgcattaagtgtggtgctcctggcatttgcatctcatcccacaggtgatctcttcagcgtcctggacttcccattcctgtacttctacagattccatggtagctgctgtgccagtggattttgggattctttctcatgttcagtacagtgaagctaaaaaaccttctggccccagggcagtgtgcagcctggattttcttgctaagataatcacagctggcttatcaatatgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgcatcacctcacccaagtgaatgtggtggtggtgatgaggncgaggcctggtgcttcaaggagcacctttctgggggtctgcaggtcactgcagaggagcggtctgttacatcttcccatttggagaacctctctcaacgtgctgtagctggttctgcagaaaccaggaagtaccaggatttcatgggctggtctggtcgctcgatgagcttcaacttctggatggcaaatgctctttcccaaaaactggtttcagtgaagggaatgggcaagggttggggagtaataccacgtaaaacttaattatttatatattttaaaaaagggcacctggggcagggatgaagggggacacagtgggacgttaacac

SEQ ID NO: 56179 - DNA, 1493 bp, Homo sapiens
  misc_feature (1163)..(1163): n is a, c, g, or t
gtgtatagctgttccagtggtcactagctgttagcagatgacgatctgtgaatagaaccataatctgttctctcttccaagctgcagcaaggcgtttgccatttccatttctgggatctcttaggctagatgatcagtaatgatgggattgtaggtaggatggctttatctgcctccactactcaatcgataaagactacatctcacttaacaagtctgccagggatttttagacagcctctgttgttgtagttgatgcatctggagggtcagcctttccagctaggtctttcttaacaaaaagtggcaaaagtgttattgcttttttcccctcttttcagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcttcctcctggccgcagcaggatgccttcccttcaatgactcccaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggattttgggattctttctcatgttcagtacagtgaagctaaaaaaccttctggccccagggcagtgtgcagcctggattttcttgctaagataatcacagctggcttatcaatatgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgcatcacctcacccaagtgaatgtggtggtggtgatgaggncgaggcctggtgcttcaaggagcacctttctgggggtctgcaggtcactgcagaggagcggtctgttacatcttcccatttggagaacctctctcaacgtgctgtagctggttctgcagaaaccaggaagtaccaggatttcatgggctggtctggtcgctcgatgagcttcaacttctggatggcaaatgctctttcccaaaaactggtttcagtgaagggaatgggcaagggttggggagtaataccacgtaaaacttaattatttatatattttaaaaaagggcacctggggcagggatgaagggggacacagtgggacgttaacac

SEQ ID NO: 56180 - DNA, 1003 bp, Homo sapiens
  misc_feature (673)..(673): n is a, c, g, or t
cccgcttcccacctgcgcggtcaccatggtggcgagcacagcaaccccaggtgtccagagcactgccccaagtgccctcttcctcctggccgcagcaggatgccttcccttcaatgactcccaggggcttataaaattctacagaagtcccagaaacccagtgcattaagtgacattgaccagcaatacttaaactatatattcaggtgatctcttcagcgtcctggacttcccattcctgtacttctacagattccatggtagctgctgtgccagtggattttgggattctttctcatgttcagtacagtgaagctaaaaaaccttctggccccagggcagtgtgcagcctggattttcttgctaagataatcacagctggcttatcaatatgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgcatcacctcacccaagtgaatgtggtggtggtgatgaggncgaggcctggtgcttcaaggagcacctttctgggggtctgcaggtcactgcagaggagcggtctgttacatcttcccatttggagaacctctctcaacgtgctgtagctggttctgcagaaaccaggaagtaccaggatttcatgggctggtctggtcgctcgatgagcttcaacttctggatggcaaatgctctttcccaaaaactggtttcagtgaagggaatgggcaagggttggggagtaataccacgtaaaacttaattatttatatattttaaaaaagggcacctggggcagggatgaagggggacacagtgggacgttaacac

SEQ ID NO: 56181 - DNA, 598 bp, Homo sapiens
cgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgctcagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggcacatcccaggtggctgggacctgccagtaggtgtcacaccacaaaact

SEQ ID NO: 56182 - DNA, 1507 bp, Homo sapiens
caggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctatggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtg

SEQ ID NO: 56183 - DNA, 184 bp, Homo sapiens
agactaggctaacagacaaggtactttatggtaggaggaatgggccataaccctttagtgcagagaaggaaggagcggatgttcctgataacacccccagagagggagtacatgggacacagacccatgcctgggtacccctgagtgttgggcccccttggcaggtgagcctgccctccagagg

SEQ ID NO: 56184 - DNA, 762 bp, Homo sapiens
atcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattagaaaaaaaaaa

SEQ ID NO: 56185 - DNA, 500 bp, Homo sapiens
ccaatctgaagtgggagcaattgaaggtttttgaggggtaatagtaggaacggtaactggaagccagaaaagctacttctgtaaactggtgtaagatgacagggatctgtgtcagggaggtagcaggaagagatgacttcaagcgacaccgcagaataagaaccatagagcttggtgcctaaatagagggctggaaatggggctgggagtggcataaggatggggaacgatttgagcctgagagatggttgtagcccaacagcacgtctcctcttcttcattagtaagagcgcccaggaaggagcaatgattaccaataataaagactacattttcccgccatgtgaatgaccaacggatgtaaatgaaagtgacatgtgttacttcgaggaaatgtccttaacaagaaagaaacaaccttattttgtccatttctctttcctgatggctaaaaggtaggtgggatggctggagctccagcagctttcttgaagtatgag

SEQ ID NO: 56186 - DNA, 2295 bp, Homo sapiens
  misc_feature (308)..(308): n is a, c, g, or t
ctcgccccgccctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacantaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttccgtccagatcgccttagggacattgctgatcgctttaatgtagaccatgatgcagtactggacaacgtactttatgcacgtgcatatactagtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacattacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggaggtcaagaccagcctggccaacatggagaaaccccatctctactaaaaaaaaaaaaattagccaagtgcagtggcatgtgcttgtaatcccagctaccctggaggctgaggcaggagaattgcttgaacccaggaggcagagattgcggtgagccaagatggcaccactgcactccagcctaggtgacagagtgagactccgtctcaaaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 56187 - DNA, 277 bp, Homo sapiens
ctcgccccgccctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggggtccaacccctgactttggtatcaaatgaggaaatggaatcgaccaagaaaaatgatgatttggaccgcattttattgtaataaataaacacaatcacgccttgtggattc

SEQ ID NO: 56188 - DNA, 3308 bp, Homo sapiens
ggtcgacggaagagttctatgcgctctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttctagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaaccgtgttactttattgaaaaacattaaaagtttgagaacttaaaaaaaaaaaaaaaacacggaggattgtaaatcaaatgaggaagggcaaaccggtcattaggggaaaagaaaaacgagcagagagaaggggaaaaccccagggaaaagacacaaacaacgaagagagaacaaaaagggggggccacaaaaga

SEQ ID NO: 56189 - DNA, 2152 bp, Homo sapiens
ggtcgacggaagagttctatgcgctctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatct

SEQ ID NO: 56190 - DNA, 2368 bp, Homo sapiens
ggtcgacggaagagttctatgcgctctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgttccccacgtaacttgcgtcccgactaacttgcagatcctctagaacac

SEQ ID NO: 56191 - DNA, 2369 bp, Homo sapiens
ggtcgacggaagagttctatgcgctctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcacaatccactgcatccggtccactgcattaaatcctctaagtcaccct

SEQ ID NO: 56192 - DNA, 434 bp, Homo sapiens
tggatttggcccacaatctgtttgccatctcctgatctaaatgatccccacttggagcaagagctaaccaaagacacactttaatggcccttatcagatagatagatgcttatatcatactttaaattcttaattatataagatgcagtttttatgtaacttcccttcacaatttgttagtaccacactcataacttaagatgatacttaagcatccacagaagcactttgcttttacaaaattcttgtatctactcctgcctgttttattacttagctatatgtcaatacaatacgtcaagttcccagaaaaactatgttagaattttgactaaaattgcaaagcaatttctgtataactcatgtatttgaaatagtgatttatcattcaggaacatggcttctatctgtatttcgttctcataaaattttat

SEQ ID NO: 56193 - DNA, 173 bp, Homo sapiens
gagctaatattactattttctaaagaataagatcagtatcagttattaatatcaggcgtcataatcatcaatattaatcatgtattgttattgttagtataactatttaatattaattatcattagtatccgtattgattttaaaaattatattatgggttattaatattgat

SEQ ID NO: 56194 - DNA, 327 bp, Homo sapiens
ctctctcacagtcctagaggctgcaagtccaagatgggcacctcatagacagctgtcttctccctgtgtcctcatggtggaagggccgagacagctctctggggtcccttttataaggacactaaacttggccagttgcgctggctcatgcctgtaatcccagcactttgggaggccagattgcttgagcccaggagttcagggccagcctggccaacatggagaaaccctgtctctacaaaaaaagtaaaatattatctgggggtggtgacagatgcctgtagtcccagctactcgagaggctgagatgggaggatcacttgagcc

SEQ ID NO: 56195 - DNA, 649 bp, Homo sapiens
ctgtctggtctgtttgaaggacagtgaggtagcctgtttggctggagcagagaagtaatgggggtcaaagagtgtgggaccctgtggccactacaaacagtgagctctttgtcctgagagcaatgggaagaccccaccgttaccctgtgaagtgggattatcaacctgcttttacataagaggagactgagggtcagggagaagtgactcgtccaagaacatctggcaagagggtggcagagcctagaacccagatcggcttcctgagccccattttgtcatcattgcccagggtctctctctaagttggcctcctctcccttgactctcaacagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctgga

SEQ ID NO: 56196 - DNA, 236 bp, Homo sapiens
tggggcccaagtccccgggagaaacgggagcggaggatgggaggagggcacgagatccgccagcagggcctctctctccagccgaggaatgggtccctgccaacaccgagcccgtggagcgctgtgtaagttcccagtagaagcagcagcagcagctgggagttagttaagcattcatcatggccaggttctaagggtggccattctgttcgctcattaattttttttttttttaa

SEQ ID NO: 56197 - DNA, 433 bp, Homo sapiens
ccaggctggtcgcaaactcccaacctcagttgatctacccgcctcggcctcccaaagtgctgggattacaggtgtgagccactgcgccccgtccagtctggtgcttttaatgaaggacggcatttggagggcgaggagggcagtggagcgagtgaggactctgtgtgttgatggggaatcatgggaggattctgagcaggggaatggcagaggcaggcctgggtttgcttggggacacgatggggtgcaaggccatctggtggctgcgttcaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtag

SEQ ID NO: 56198 - DNA, 344 bp, Homo sapiens
gccacctgactctcctgccccctgcagatgtcccagaccccccggaggctgtgcgcatcacctcggttggagaggattgggccatccttgtctgggagccaccaatgtacgatggggggaagccagtcaccggtgagtgcctctgtcctcatgacctctgaccttccctctttctgccttctgtttttttttttttttttttttttgagatggagtctcactctatcgcccaggctggagtgcagtggctcaatctcggctcactgcaacctctgcctcctgggtacaagcaattctcctgcctcagcctcgcaagtaactgggattacaggtgcccaccacca

SEQ ID NO: 56199 - DNA, 3561 bp, Homo sapiens
cgggaggaggtcccccgacatgcctgaggcaaaaccagcggccaaaaaggcccccaaaggcaaagatgcccccaaaggagcccccaaggaggctccccctaaggaggctcctgcagaggcccccaaagaagccccacccgaggaccagtccccgactgcagaggagcccaccggcgttttcctgaagaagccggactccgtctcagtggagactgggaaggacgcagtggtcgtggccaaggtgaacgggaaggagctcccagacaaaccgaccatcaagtggttcaaggggaagtggctggagctgggcagcaagagtggcgcccgcttctccttcaaggagtcccacaactccgccagcaatgtgtacaccgtggagctgcacattgggaaggtggtactgggggaccgtgggtattaccgcctcgaggtcaaagccaaggacacctgtgacagctgtggcttcaacatcgatgtggaggcaccccgtcaggatgcctctgggcagagtctagaaagcttcaagcgtacgagtgaaaagaagtcggatactgcaggtgagctggatttcagtggcctgttgaagaagagggaggtggtggaggaggagaagaagaagaaaaagaaagatgacgatgacctaggcatccccccggagatttgggagctcctgaaaggggcaaagaagagcgagtacgagaaaatcgccttccagtatggcatcaccgacctccggggcatgctgaagcggctgaaaaaggctaaggtcgaggtcaagaagagtgcagcattcacaaagaagctggatccagcctaccaagtggacagaggcaacaagatcaagttgatggtagagatcagcgacccagacctgaccctcaagtggttcaagaacggccaggagatcaaaccaagcagcaagtacgtgtttgagaacgttggtaagaagcgaattcttaccatcaacaagtgcacgctggcggatgacgctgcctatgaagtagctgtcaaggatgagaagtgtttcaccgagctcttcgtcaaagaacctccagtcctaattgtcacacctcttgaggaccagcaggtgtttgtgggtgaccgggtggaaatggcagtggaggtgtcagaagagggtgcccaggtgatgtggatgaaagatggtgtggaactgactcgggaggattccttcaaggcccggtaccgcttcaagaaggacgggaagcgccacatcctcatcttctcagacgtggtccaggaggacaggggtcgctatcaggtcataaccaatggcggccagtgtgaggccgagctgattgtggaagagaaacagctggaggtcctgcaggacatcgcggatctgacggtgaaggcctcagaacaagctgtgttcaagtgcgaggtgtctgatgagaaagtgacgggcaagtggtataagaatggggtcgaggtgcggcccagcaagaggatcaccatttcccatgtaggcaggttccacaagctggtgatcgatgacgtccgccccgaggatgagggagactacacgtttgtgcctgacggctacgccctgtcgctctcggccaagctcaacttcctggaaatcaaggtggagtacgttcccaagcaagagccaccaaagatccacttggattgctcggggaagacctcagagaatgcgattgtggttgtggctggaaacaagctgaggcttgacgtgtccatcacaggggagccccctcccgtcgctacctggctgaagggagatgaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtagatgtcccagaccccccggaggctgtgcgcatcacctcggttggagaggattgggccatccttgtctgggagccaccaatgtacgatggggggaagccagtcaccgggtacctcgtagagcggaagaagaagggctctcagcgctggatgaagctgaactttgaggtcttcacagagaccacctatgagtccaccaagatgatcgagggcatcctctatgagatgcgtgtcttcgccgtcaatgctataggggtctcccagcccagcatgaacaccaagccttttatgcctattgcacccacgagtgaacccctgcacctgatagtggaggatgtgacagacaccaccaccacactcaagtggaggcctccgaacaggatcggggcaggtggcatcgatgggtacctggtggagtactgcctggaaggctccgaggaatgggtccctgccaacaccgagcccgtggagcgctgtggcttcaccgtcaagaatctcccgaccggagccagaatcctcttccgagtagttggggtcaacatcgcggggcgcacggagccggccaccctggcccagccggtcaccatcagggagattgcggagccacccaagatccggcttccccgccatctccgccagacctacatccgcaaagtgggcgagcagctcaaccttgtcgtccccttccagggaaagccccggccccaggtggtgtggaccaagggcggggccccgctggacacctcccgcgtgcacgtgcggaccagcgacttcgacaccgtgttcttcgtgcgccaggcggcccgctccgactccggggagtacgagctgagcgtgcagatcgagaacatgaaggacaccgccaccatccgcatccgcgttgtggaaaaggctgggccccccataaacgtgatggtgaaggaggtgtggggcacgaacgcgctggtggagtggcaggcccccaaagatgatgggaacagtgagatcatggggtatttcgtccagaaagcagacaaaaaaaccatggagtggttcaacgtctatgaacgtaacaggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgcgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctgga

SEQ ID NO: 56200 - DNA, 2454 bp, Homo sapiens
tcgctttcttgggcctccgggcgcctcaaaggtaaaactaggccatttgaagcctgcgaagcgaagggcagtcggtcttcaggcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggccacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctcaaaaaaaaaaaac

SEQ ID NO: 56201 - DNA, 2505 bp, Homo sapiens
tcgctttcttgggcctccgggcgcctcaaaggtaaaactaggccatttgaagcctgcgaagcgaagggcagtcggtcttcaggcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtagacgaggtcccactttgttacccaggctggtcttgaactcctgagctcaagggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggccacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctcaaaaaaaaaaaac

SEQ ID NO: 56202 - DNA, 1642 bp, Homo sapiens
tcgctttcttgggcctccgggcgcctcaaaggtaaaactaggccatttgaagcctgcgaagcgaagggcagtcggtcttcaggcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctgagaagtgcaggaaacaagaccgatccacccacctcggcctcccaaagctctgggattacaggcatgagccactgtaccc

SEQ ID NO: 56203 - DNA, 541 bp, Homo sapiens
gtttgagagagcgggagagtggaagaagagtttgaaggaggaagagaccagaccttggagaatcttgcagactttggaagccattggaaagttttctctttttattcctaaatatatcatatttatgatcttatatcaaatgtcgagatattttatatttatgatttatatcaaatgtagagatattttatatatttacttgcctaaatagagtcaagaaattcgaattgcttaacgatttttttgtttgtttgtttttgagacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaa

SEQ ID NO: 56204 - DNA, 374 bp, Homo sapiens
aactacttgggaagctgaggtgggaggatcgcttgaacccaggaggtcaaggctgcagcgagccatgattgcaccactgtactccagcctgggtgacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaa

SEQ ID NO: 56205 - DNA, 349 bp, Homo sapiens
aaaccatccatagctacttggcaataaaagcatcggccactgttcagcctggagaatatacctcatgtacaggttttcaggtgacctgctgcccagttggggctgcttggggctgcagccaggctttctcggatggggacctgattgactccttgcataaaagtcatggaaggactactttcttaggagactgtatggctgaaaatacaaatagcttcaaatgggtttaggaaactcttggattaagaacccatgcttggccgggcacggtgtctcacgcctgtaatcccagcactttgggaggctgaggcgggcagatcacctgagttcaggagttcaagaccagcct

SEQ ID NO: 56206 - DNA, 427 bp, Homo sapiens
accttgattgcagcccaatgaaactgatttcagaccctccagaaccaggagagaattcattccgtcatcttaagccacccagtgtgtgataatttgatatagccttgggaaacaaatacacctgacctccaaaaccctcctcaccctgacccccaaaaccctcctgccttctccgtgtctaagcacgtcagatttatgggggatggaataatctagaataatctgaaataattttaaaaggaaaaaagaaaaggggatcaagaagaaagagaggagagggtgagtgtaaggagggctaaagcccgagtgtgcagggggatcataatttactcagaagctgcaggaagaagagccctatgtccatgcctctctcgactctcctccagggaatgttctccacaagtgggggaggctgagagttctcgag

SEQ ID NO: 56207 - DNA, 298 bp, Homo sapiens
aatcatatggttggtactcagtaactgctggctgcatgctggaagcttagccttaggaatggttcttcttgaacttcagggtgcttcacaatccctagggagcctgttaaggatggtgacaccaggatccatgcccaaagagcatgaaggggctggtttgggcttggccaaggatcacatatttaacaaatcctactgagggtccaacagggaactcctctccacccacctgacaggagacagacctctctttccccagggacccactccattctccccaggagtgcttcaggacccg

SEQ ID NO: 56208 - DNA, 540 bp, Homo sapiens
caatttgggggctagaatgtatgttagagacatgatatgtccataggtccttgctatcacagtgaggtctcagggacagtcgtttggtatcatttgggatctcataagcagactctctctgcttgacctgacaaatcagagtctgtgttttaacaggttcagtgagtgacttacatgcacattggagtttgggaagctccactgtaggtgcttagaccttacctttgttgttgctaataacaatgcaagcatttgggaggaagacctgtgttgctcatatgtgtccaggtgtagctgaggtggccttgcttatctgctgtagggccgttgagcatttctgtagctgtgatgagtgagctgaggtgagcctgcggagagctcccagccattggtagtgggactcgcttagatgaactggaaggaccctttcatctgagcagccactatggagaaaaacaaccgaatgaggggagagacaatgtgcaattttatttagggcacaaaggagagctgtggttagaaggtgacatttgagtggaa

SEQ ID NO: 56209 - DNA, 274 bp, Homo sapiens
cggggaaacaaaaagtcatgcaagacacatttcacagcctttgcaaacgcttgccctgggctgccagccagacctttgcaaaggacggaggcgccttcatccccacccccttcccaagggcacagttggccgcccttcttcaccccgacatcctcactcagcacctgctttatggcgtatgatgccacctgtgggggccctgagggggacacgtgcaggtgtggcaagcagctgttagctcccaggcccagagcaccccagccacttaggagtg

SEQ ID NO: 56210 - DNA, 372 bp, Homo sapiens
cacactgaaccaggtctagaaaccttcttagcgcccaccagaaaagacacctccctcccctactcctatggccaacaaacccttcatgatcttggtgtggataatgtaaacccagagttgaagcaccagagctgaagaggaggctcaggggtaagtgttttacagcatcctcttgtttaattaatccctcccacaacctgtgagtacatagtattatccccattttacaatggctgactttcagaaatcttttgtaactttcccaaactcagacaactaggaaatggagaagccaggattaacataggtctctctgattcccaaactgtactcagaacctcaatgcttagcaatttcttctagcagacagcc

SEQ ID NO: 56211 - DNA, 218 bp, Homo sapiens
ttcatacccaaggccatggccatttgctattccccatgacgcccagggtggccagtatcttcatttcatacccaaggccatggccgtttgctgttccccatgacgcccagggtggccagtatcttcatttcatacccaaggccatggctgtttgctgttccccatgacgcccagggtggccagtatcttcatttcatacccaaggccatggccatttg

SEQ ID NO: 56212 - DNA, 594 bp, Homo sapiens
aataaaattaactttaattatttaaaagcctgtttttttttctttagttgacataacataccaggatattgtagctggaaatacataggaggttcttgctctcacgaaccttacattccagtaaggaaaacagacaataagaaaaaagaaaaatgaatacaataaattctcatggtgatacaaataaggtaagatgacagaaactgaagggagagggagacactacttcagtgaggtggtcagtgaaaacctctctgcaaaggtggtgtgaaatctgagacctgaatgacaagaaagaactagcgatgcaaacatctgcgggtggcacatttctaatatttattttttactagttttattttgtgttaattttacgtttaactatctggaatatattttggtacaggagtcccccttatccaagggggatatgtatcaagccccccagtggatacctgaaatcacagatagcgctgaaccctatatgtactgttttttcctacatatatgtatctatgataaagtttaatttataaattaggcatagtaagatatttacaaaaataataataaaattgaacagttataacaata

SEQ ID NO: 56213 - DNA, 434 bp, Homo sapiens
tttagtggaatcaaggagttcagcactactccccaccttcttggcatgggatcccaaggggttactagaaggaaagaaggaatagtaaatgtccatctttgaatccccactacctttcaatgtgcatggcatatagtaggcattcagtaaatagttgttaaaagattaaactcggggattagagcaagatttttattagaatccttgaaaattggtcataactctctagatctgatgacacttggactcagtcatttacccccaaatccctcctatctgcactagttacgtctcaaagcactcacctgcttctacacatttatatactatgacctccactagaatcatagcacccaaaacttcatggaagggaatttagggtcacatagttcagcctcccacactgagtagccatctagcctccaaatattaac

SEQ ID NO: 56214 - DNA, 502 bp, Homo sapiens
ccgcccaggggtgaataagagacagctgctctgcctacttgaagcttgcatctgagtgaagatgaactttcctttcccagccttgagagagggaggctgagctcagtagctcagctcctgggttggttttgaacagtaaatgatctaggtacctggccagcacagctcctggtgcccctttcctgaaggctaacaatgcagttcaaattatatgcttatgcatgttcagaacacagtagacatcatgtgtcggtgggtgttgagctggggtccctggctgcctgttgctcttaaggagtgatacagccatcctcccctatccgtggggaatgtgtgccaagaccccgagtggatgcctgaaactgcggttagtaccgttgatcagaacttggtggctcatgcctgtaatccctgcactctgtgatgctgaggtgggtggatcgcttgagctcaggagcttgagaccagccggggcaacatctccaccaaaaatacaaaaaaa

SEQ ID NO: 56215 - DNA, 386 bp, Homo sapiens
tgatatgcaattgtgaaaatactttgagggtttaaagaaaaaatgccatgtagcagattgggagaaattacctgattgttaactctctgaaaccttaaggggttaaccgctgtctcgctccattcctgctgctatgacaaaataccacaaactgggtatttactataaagaagagaaatttatttcttacttatctggagtttgggaatccaggatcaagcctgcggcattcagtggctggtgagggctgctctccgcttccagaatggcaccttcttattacatctcctggaggggacaaatgcttgctgtgtcttgcatgatagaaggacataagggcctagctagttctctccagcccttctataaggcaccaatttcatttc

SEQ ID NO: 56216 - DNA, 234 bp, Homo sapiens
gaacttttcattagtaatgagactccacaacgaggaacaacctaatacacctgaaacccaaggcagacacccaatccccagggccaggccagctccagttaccaagcacaggtcccaggagtgccccagcccctcccactgcaggaaaccagcatgtgtgggccatgtgcacctcctgtgggttgtggcaggaggtcacctctaaagaggtcaccctgtgcagccctcaaacac

SEQ ID NO: 56217 - DNA, 731 bp, Homo sapiens
ttaattttcatgttagacatttggattatgatagtcaaggccgcagttgtctaaatgtaaatagtaccgagggaagagtagcacattccgacattctctcagtgagacttattcatcagatgggggctgtgagtgggtgagatttcacacagatggatgggagtctgctggaaggaaaaattcagagcattgaaggttctgcctgtgtgagtgtttgttgggtgaatgaggggactgagtaggaaggagggcaggcaatgaggctttaaagggaagaaggtaggaaatttgaactcatctttcctagtgcttactctcagcccattccctggtttgtggacctgaccccacactgctttttccagcaccactgtctgtgtgagtccattcacttcaataccagagccacctctttgtttcctatttactaagaagccataccagcatgagatctccttgatagtgttaaatcccactgtggaaagattgaaaaatatctcccagccttaccagaggttacgatctagtgtggaggcaaaagacattgagaagaaaaaagcaggtgcctcctcctggctctcctgttaggttaacataatcataattcccctttgaaatgtctcccacatttgccctttaacttcctattgccatgataagcatttaggttattacctaaataacttgttacctcatgccttgattatctaaataaattcttagatggccac

SEQ ID NO: 56218 - DNA, 528 bp, Homo sapiens
agacattgtattcatttctttattgtgtttacatagcacatactctccaaagagttcagggtacttttcaaaagacattgaataatgaacacataaaaatataccaacagtaaaaagtaggaagtagaggagaaacaatcaaaggaaggtgagatcaagcagtggcaaaaggattagctatccattcacttcaataccagagccacctctttgtttcctatttactaagaagccataccagcatgagatctccttgatagtgttaaatcccactgtggaaagattgaaaaatatctcccagccttaccagaggttacgatctagtgtggaggcaaaagacattgagaagaaaaaagcaggtgcctcctcctggctctcctgttaggttaacataatcataattcccctttgaaatgtctcccacatttgccctttaacttcctattgccatgataagcatttaggttattacctaaataacttgttacctcatgccttgattatctaaataaattcttagatggccac

SEQ ID NO: 56219 - DNA, 363 bp, Homo sapiens
ggaaaacctaacatggagacagggagacaccctacccaagcagctctttagaattagaagcacagttgcggcctgttggttaacttctctgaatgtttttgagaactaagaactgtgtgactagatacttatgtcctaatccttgcctgttaataactgctttttatataaacaactgagactatttaaggacactacaagtctctacacagttttagaaacctagcacatttaatttaattgtttgtattgcttaactcagtgactaaagatgttcagaggttaggctagatctttgaaaaatgtgttcattagaggtccactgtctgcttacctggaaaaagaaaaggcaggatggcaggt

SEQ ID NO: 56220 - DNA, 149 bp, Homo sapiens
ccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacat

SEQ ID NO: 56221 - DNA, 172 bp, Homo sapiens
aaaaaaatgaaatgataagtaggagaagcactggttttcctagaagaaagaagttctagaaatctatggcattattatttttatcaatttattgttttactcatagaacaaatgtgttaaagagtcttcaagaaagatttatctatggcatgctttgtccaggagcacagct

SEQ ID NO: 56222 - DNA, 182 bp, Homo sapiens
atataaataggaataccttggagatatttcaggctttattccagaccaccacaatgaagtaaatattatgataaagaacaaaaacattttgttttcccagtgcatataaaagttatgtttacgtatactgtagtctattaagtgcacaataccattatgtttaaacatacaaggtatatacc

SEQ ID NO: 56223 - DNA, 445 bp, Homo sapiens
ccccagcagtgcctgcctgttgtggagaatctgtgctcctgggaagggaaagcgcagtgactgtcagacgttgcacagaactcagtgcttccctgtcatagcagaaagcaaaactgggctgaactcaacggacgcctacccagggagtaagcatagcgaccagcccagccagaggggaatcgcccaccccaatggtcaggacttgagatctggcaagccttgccactgtgggctggagggctctgaagtcctaaataaacttgaaaggcggtcgaggccacaaggactgcaacccctaggcatgtcctgtgctgagctgggctccgagccaggggacctggttgggttgggggagcacaacctactgagacaccagttgaggtagctaagggtgtgcttgtgccacccctcatgcaaccccaggctacgtggctccttccttcca

SEQ ID NO: 56224 - DNA, 254 bp, Homo sapiens
cttgtgtgataccttgagaaggggtggatccacatgccagcctacgcaggagcaagaggaccagtgcttcttctcctttcttggtacatgccagcacggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgc

SEQ ID NO: 56225 - DNA, 594 bp, Homo sapiens
aggcaggaagaatggtgtgaaccccggggaggcggaagcttgcagtgaagccgagatttgcgccaccgaactccaaccctgggagacacagcgagacgccaccgtgcctggccccaaactctttatagaaataaataacaacaaatgatcattaacctgtttcagccaagggttggagtttaacatcaaggtgagttcttacatattacatgcaaaacagtggcccatgaatttttttttttttggattaggtcagaattatcatgttaaatcttttgagaagaataaagcaaaatattagtaactaatttcattgaagatctcaaacataagttagtaaaattaagaaacaatttgaatttcatatgtttttagagggaagttcactcctttgaaagttgaaaaagaaagcagatgtacttaaatatgggacattcttttgaacttagaattcagattatatatcctcagagaatccagtatataggagaaactacaattagctaaactaattttagctacttgagttcaattcagcaataagacaaaaagtgaatgcaaaatgtatcatgtgcttattaggtcatagtacaa

SEQ ID NO: 56226 - DNA, 396 bp, Homo sapiens
gctggagtgcaatggtgccatctcggctcactgcaacctccgccttccaggttcaagccattctcctgcctcagcctcccgagtcactgggattgtagacatgcaccaccacactcagctttgtatttctctagaagaaaatagggtttctccatgttggtcagcctggtcttgaactccgacctcaggtgatccgcccgccttaggcctcccaaagtgctgggattacaggcgtgagccactgcacccaggcccaggtttagttctaaaacttcctttagcctgataccctggctgaattaggcaaattctggcaataagaattgactagctgatccacctaaccagttgctccttttgccgcgcacacacacaaacacccctgtggatagggaa

SEQ ID NO: 56227 - DNA, 373 bp, Homo sapiens
ttagaaatgcagacatttaatgggttacgaagcttaactgctagacacattcattagatgtgaacagttaatatgtagtcatttctgttggcttctaaattatcctcatcactcttttgagacatagcagctcatcctaggccaatgatatcaaccatggctgtactgtgaactgtaatccagtatctttctctcaacacctcctctcttctcagctaagatattgaagatgctctgcttttccctctgactttcatcacttaaaactttgttgatttcacctgaggaaaattgacaaatatttttaatcatctttcacctttctttctcacttccaactcttctccaattgcctgactaaaatttctattcc

SEQ ID NO: 56228 - DNA, 467 bp, Homo sapiens
cttcacattattttaattctgtattcaactaagcactaattcaacccagccagattagtactcataccaaaaaagagtgaatactctgaatagagggcaggttttctgattatggtgagaatatctttgtggtaaattaatctggtgtgctagtttttacgttggtctcttctcagtgtcgttagtcactgaggctgattgatcatcttttaggttactgataaagttcctgtacagctgattttcagaccttagattgcaataacttcaccaagaaaatacttcattgggaagcattttggtccttccatttgattcataactcttacctttatgcctctgaaggaaaagatttatacattcagcttgtaattagtaatcaagactgaggtttagtctatctagcttcacaatctatctagtttgttttgtctagccatatgatttcttcaaatatgccatttctt

SEQ ID NO: 56229 - DNA, 725 bp, Homo sapiens
cgcaaggtcacattatcagaagattagaaaaatggctagattaagtacacacagtcaccaagctgtgtaccccaggagtctgggagcaaactgccacaatatattagaatttgcactgctgtggggagtgttgtcacaaggttttactgtgtcctaggataggcatttcatgctttttccctcatgccttccaaaactggcaggaagatgagggtgggtaagcagaggcctcttcaggctccctcctctgcccaggatccaggggttatctccaactgcctcttttcactcaggagaatctcagccccacggggcacctccaagacctggcctggccagagagagatcagtgctcccacgaggaggagctggggaataaactgctgactggctctgcaaagcgggtgttttatgcatgaaccacccctttcctccttccagcatgcctttcaccctgcctttgagaggggtaaccacccccaactcattcacagatctcccctggctgccccatgagcacagggaaggcccactctcagccatttttttgctcacaagcttcagagataccttttccaccctggacagctcccactgtgagactactacaccacagtgctggaatcagcctgcctgcaacttccaccatccatctctgtcacacctccgagcccatggaatgaacctgttcctttttgtaatggctgcttgagacattgcagtaa

SEQ ID NO: 56230 - DNA, 4386 bp, Homo sapiens
gctgatcgggggtagaaaacggtgggaaccacattggccggtcaggatcggaggctgaaggaagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggatggtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaaagcccccaaaggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctagaagtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaa

SEQ ID NO: 56231 - DNA, 4568 bp, Homo sapiens
gctgatcgggggtagaaaacggtgggaaccacattggccggtcaggatcggaggctgaaggaagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggatggtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaaagcccccaaaggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctagaagtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaaaaaaaaaaaaaaaaaaaaaaaaaaaaaaaaaaaagaaaaaaaaaaagaaaaaaaaagcaaaaaacaaaaaaaagagagaaaaaagagagaagaaaaaaaaagagacagggggggggcaggcaggaagacccggcgcggggagggagcaggagagcaaagagagaagagcaagaaggagagac

SEQ ID NO: 56232 - DNA, 442 bp, Homo sapiens
caaaatcctatgcctgtgggtgagttgagcaacgtgatgaggtgttaacttcctacagggaggggctcaaatattgcccaacagtggtatggcccactgcctggggtggtcggtggaaggctggcaggacaagggagaccacgtggccagtgggtgctgccaaagtgacggaacagggagttcagacgggagatgccgaatgccctaatgtccttgggaacaccttatgcactgtgttccacctgagccaacctctgtcattaccgtcattccttaattaaccatatcttttctctctaaattccttcccacgccccacctttttgtgtttctgtatttgcggtctgtctctccgtacaggtggaaaaacctagtgttcagagttccaaaccaaaaaagacctcagcgagccataagcccacgaggaaggccaaagacaagc

SEQ ID NO: 56233 - DNA, 321 bp, Homo sapiens
cccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaaagcccccaaaggtggcaagtgccaccttcgctgtgctagagttgtgttgtaggaattagtcagggagttgttgtgaaaaaaaaa

SEQ ID NO: 56234 - DNA, 209 bp, Homo sapiens
ggggagtcagtgattttttttcattttaaatttagccttcatggagttttagttatttggttttatccaagaaaagcaactaaatgccaaaacattttacatagtgggctaaagataggaagtgcacatatgtatggcatgtgttctatacattattagatctctgccttcatttctaatgctaatacaatcatgtgaagagttaagca

SEQ ID NO: 56235 - DNA, 215 bp, Homo sapiens
cagaaacagaccatttgaaacatggtacacatttattaatagagatcctactctttggagtctgtgataatttgtaggtagctaagcaaaactttttaagtataccacctacccatctaaggagagagtgtttcccaaacaatttaacagcatcaataagataacagtgtttgctcctctcaggcaagtcagctgcttttgcccaggcacataca

SEQ ID NO: 56236 - DNA, 359 bp, Homo sapiens
caatttgtgtttttcattaacacaggtaccaggacccctgtgaagatacccatggttcaatcatcaggacctacagatccttccatgttaaggacaacaccaataatactgagaaagcaaacggcagattggcagtgttaaaggataacaacgtgccaacagaatattaagaaagaaaacttctttgcaaaagttgatagagagactacaaatatcagtcaaattacaaacagacaacagaggacagcatttggaaacgacttcccgaggcaagcactattcagtgccccacttccctctccccatgcccctttgcaaagatctattacattaataaatttctttaaatgctaaaatca

SEQ ID NO: 56237 - DNA, 958 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56238 - DNA, 995 bp, Homo sapiens
ggccaatatgaaccacttaaggattttcagcagaatactgtagatgaattttcatgttcagaagatgattctagcagcattgtggaggatgggctggaggccagtgaggagtctactgcagtagtagtccaggcaagagaaaagaggttttacatgaaaatatgggtctggggaacactggagatttggcagcaaatatttatgtgcctgctgggcatgtgacactgtatgttccctgtcctgaaactcagaagctctgccagctgaaaaggccaggagtggagagaatgtctggctccagtccattccagtccagtacaaaggcaaagctgcttgcattgcagccaagtcttacacacgtagaggttccattctcttcagtggaatactatacagccttaacaaaataaagaggtagatctggatgtgttggcaagatttctaaggtaagttaagtgacagtcaagatgtagtaatttatgtaagcatgttactgtttattttgaatgactttcaggaatctctgcagtgatatatagcagactgtggataatacttctgcagagtagagatagcaaagagacttttcagttgccttatttaagcttgaattttctaccttgaacatgtatcttgtaatagaaatacatactgtttatatgtagtgttaactaatcctaaatcctcccagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgtaagtctggttttctctggactgagaacttgttgaagcaaggatcatgctgactaacatagtgcctggtatgacagagcttaggtcctggcacaccatgcagcttacaaagtacatttatacattttcatacactttgcttg

SEQ ID NO: 56239 - DNA, 785 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataagttgtgtcggggggtggtggggtggcgggtggggtggga

SEQ ID NO: 56240 - DNA, 955 bp, Homo sapiens
cccaaacataggctagtggaggcctgggtccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56241 - DNA, 1181 bp, Homo sapiens
cggacgcgtgggttctagatcgcgatctagaacccatggcggtggcaaattcaagtcctgttaaccccgtggtgttctttgatgtcagtattggcggtcaggtgagatccaggaggctgcccacacctgcgccgaagggaaactgctcggggctaggcaggcagaactcacccagagagagcggactcgggaagccagccagaaagtgaaattgcacccgaacctaccgacctgccgggcggggggaaaggaggaggaggagtctccccaatcctagcgccccgcttctggaggaactgggcggttagactagggaggcggaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56242 - DNA, 947 bp, Homo sapiens
gggtggtgggtcagcccatcatgccccctgctccgtgaagccctcatggtcttggactgggccttctgacactctcccgctgattgcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56243 - DNA, 1078 bp, Homo sapiens
cggacgcgtgggttctagatcgcgatctagaacccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56244 - DNA, 998 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagcacttcccaggagcctgcccacagctgtggctaacatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56245 - DNA, 900 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaa

SEQ ID NO: 56246 - DNA, 1119 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56247 - DNA, 983 bp, Homo sapiens
  misc_feature (959)..(959): n is a, c, g, or t
  misc_feature (962)..(962): n is a, c, g, or t
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaaaaaaaaaaaaaaaaaaaaaaaaaaaaaaaaaaaaaaaaaaaaaaaaaaaaaaaaaaaanagnaaaaaaaaaaaaaaaacaaaa

SEQ ID NO: 56248 - DNA, 901 bp, Homo sapiens
cggacgcgtgggttctagatcgcgatctagaacccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaa

SEQ ID NO: 56249 - DNA, 913 bp, Homo sapiens
cggacgcgtgggttctagatcgcgatctagaacccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagagcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56250 - DNA, 1030 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggtaagtgtgtctttctcctattaggttaggaatcagacctcagagaaggcagcatggtctagtggaaagaactttagtcttgaagacatgagattgagcccagttcctccgtgtatggccttggagtagtcactttccttctctgagcacatttcctcatctgtcaaatggaaatactgtaatacctatctctcagagtcactgtaaaaataaaaagagaaagggttgtaggagcactttacttttctatcactttgtaatgtacaaagtatcaatgtgaaaactactcaggcagtttgtaacagcactctcagactacagttccattcagtagtccccctagaaagacctggctccaggcctgagtaactctctgctgggaccaggccaggcagccaggagacacacctgtcatgcctctcatcagaactgatactgcaa

SEQ ID NO: 56251 - DNA, 923 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56252 - DNA, 831 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggtaagtgtgtctttctcctattaggttaggaatcagacctcagagaaggcagcatggtctagtggaaagaactttagtcttgaagacatgagaaagacgttcagggagcaagggctcagaaatggaagctcattttaattcaggattctcatgatgataacagcttgttgaccaaggaagagaaatgggtcactagtatgtatgagattgactgctccacataaggggtcctctaggtcgcc

SEQ ID NO: 56253 - DNA, 912 bp, Homo sapiens
cgtcgacaagacgacagaaggggggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttgaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56254 - DNA, 893 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgtaagtctggttttctctggactgagaacttgttgaagcaaggatcatgctgactaacatagtgcctggtatgacagagcttaggtcctggcacaccatgcagcttacaaagtacatttatacattttcatacactttgcttg

SEQ ID NO: 56255 - DNA, 691 bp, Homo sapiens
agctcgtgccgacttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttgatcattcatggactctatggagagaaggatggaatggtcccaacaggcccaaccattaggccaagcttactgtggtgacctgcaatggtgggagaatgtattcacacggacggattaaggtaatggggcctttcccattaaggtaaggattcacacttacacccgagtctctccgggtggcccttggaataaccctttgctttcttgagccccatttctcatatgtgcatgtg

SEQ ID NO: 56256 - DNA, 667 bp, Homo sapiens
  misc_feature (643)..(643): n is a, c, g, or t
  misc_feature (646)..(646): n is a, c, g, or t
cggacgcgtgggttctagatcgcgatctagaacccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatgaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaaaaaaaaaaaaaaaaaaaaaaaaaaaaaaaaaaaaaaaaaaaaaaaaaaaaaaaaanagnaaaaaaaaaaaaaaaacaaaa

SEQ ID NO: 56257 - DNA, 1221 bp, Homo sapiens
ggccaatatgaaccacttaaggattttcagcagaatactgtagatgaattttcatgttcagaagatgattctagcagcattgtggaggatgggctggaggccagtgaggagtctactgcagtagtagtccaggcaagagaaaagaggttttacatgaaaatatgggtctggggaacactggagatttggcagcaaatatttatgtgcctgctgggcatgtgacactgtatgttccctgtcctgaaactcagaagctctgccagctgaaaaggccaggagtggagagaatgtctggctccagtccattccagtccagtacaaaggcaaagctgcttgcattgcagccaagtcttacacacgtagaggttccattctcttcagtggaatactatacagccttaacaaaataaagaggtagatctggatgtgttggcaagatttctaaggtaagttaagtgacagtcaagatgtagtaatttatgtaagcatgttactgtttattttgaatgactttcaggaatctctgcagtgatatatagcagactgtggataatacttctgcagagtagagatagcaaagagacttttcagttgccttatttaagcttgaattttctaccttgaacatgtatcttgtaatagaaatacatactgtttatatgtagtgttaactaatcctaaatcctcccagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56258 - DNA, 1150 bp, Homo sapiens
cggacgcgtgggttctagatcgcgatctagaacccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggtaagtgtgtctttctcctattaggttaggaatcagacctcagagaaggcagcatggtctagtggaaagaactttagtcttgaagacatgagattgagcccagttcctccgtgtatggccttggagtagtcactttccttctctgagcacatttcctcatctgtcaaatggaaatactgtaatacctatctctcagagtcactgtaaaaataaaaagagaaagggttgtaggagcactttacttttctatcactttgtaatgtacaaagtatcaatgtgaaaactactcaggcagtttgtaacagcactctcagactacagttccattcagtagtccccctagaaagacctggctccaggcctgagtaactctctgctgggaccaggccaggcagccaggagacacacctgtcatgcctctcatcagaactgatactgcaa

SEQ ID NO: 56259 - DNA, 669 bp, Homo sapiens
aaaatattgtataagattaccttatacaatagctataagtagtgggtgtggtggcaggcgcctgtattcccagctactcaggaggttgaagcaggagaattgcttgaacccgggaggcggaggtggcagtgagccgagatcgcgccactgtactccagcctgggcaacagaatgggactctgtctcaaaaaaaaaaaagagaatagctgggagcattgtctcatatgggatgtccccttccagttcctctgaggtgcttacctccccatcccacactgacctccatgtctctgccattgtgccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56260 - DNA, 556 bp, Homo sapiens
ggtgaatgccttgcatcttccagcctacatggactcatttcttacccgtaattaccactgcctgctctgcgctgggcagcatgctagctgcagagagggggacaaagaattgaaagatgtctcctttcaggagctcatggaaagtaagacattcccagaggtgatcactagtaatatgagtgacattgccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56261 - DNA, 408 bp, Homo sapiens
aggggcgagaagttgagtcttaggaaaagggctgggcgagccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtaaaagaaaacaaaaagaaacccggaggggaccatatagacgggtggcgaaaaaaaggcgtcacgcaaactggcgaccatggggccaaagagctggcccctgaccaaggcttctctgggacacaaagggtaaatctcggcggacccccataagtgacgccggtatcaattccgataaagcacggtaacctgctagg

SEQ ID NO: 56262 - DNA, 501 bp, Homo sapiens
  misc_feature (477)..(477): n is a, c, g, or t
  misc_feature (480)..(480): n is a, c, g, or t
gtacgatgccagtacccattgtccactggagcaaggtgtggcatgtttgaggaatggcaagaggagggggacaatagtatctgggtgtacttactctgttctcttagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaaaaaaaaaaaaaaaaaaaaaaaaaaaaaaaaaaaaaaaaaaaaaaaaaaaaaaaaaaaanagnaaaaaaaaaaaaaaaacaaaa

SEQ ID NO: 56263 - DNA, 821 bp, Homo sapiens
cggacgcgtgggttctagatcgcgatctagaacccatggcggtggcaaattcaagtcctgttaaccccgtggtgttctttgatgtcagtattggcggtcaggtgagatccaggaggctgcccacacctgcgccgaagggaaactgctcggggctaggcaggcagaactcacccagagagagcggactcgggaagccagccagaaagtgaaattgcacccgaacctaccgacctgccgggcggggggaaaggaggaggaggagtctccccaatcctagcgccccgcttctggaggaactgggcggttagactagggaggcggaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggtaatgccccaagggtctgtccctagtttatttgccttctttatgtctgtcaaccatctttaggagagtccttttggctccagtgcatggtaaactggaaaggccttgtgctacctgctgtcactccaagtctctttcttttcggttataggaaagatggggttccaataggatacaaaggaagcaccttccacagggtcataaaggatttcatgattcagggtggagattttgttaatgtaagtactattcctttcctatcaaagacccgtagttttagtttttgttgt

SEQ ID NO: 56264 - DNA, 83 bp, Homo sapiens
acgttaatctaatacaataataacaacatctatgtttttctaaaccataaaatcttctcagtattctttgctctctgtttcag

SEQ ID NO: 56265 - DNA, 3724 bp, Homo sapiens
  misc_feature (2149)..(2149): n is a, c, g, or t
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggnagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaaatacaactttggcttgttaaaaaaaaaaaa

SEQ ID NO: 56266 - DNA, 3150 bp, Homo sapiens
  misc_feature (2149)..(2149): n is a, c, g, or t
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggnagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaaatacaactttggcttgttaaaaaaaaaaaa

SEQ ID NO: 56267 - DNA, 4289 bp, Homo sapiens
  misc_feature (2149)..(2149): n is a, c, g, or t
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggnagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaaatacaactttggcttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagacgaggccaaccaaacaacaccactgccagctgagcacagccacacactgtcgcatcactaaccccctcactagtcctaatacagcaggcgccgcaccacaataaggcgaccaacaatcacaccgagcggccgcgcgcgcccccgcaacacacacgcctggccgcgaccaacacacacgcaccgcgacatcacccacggcgcaccacccacagccccccaggaccagacgcaacccacgcatccccccgcacacaccacccgcagcacacgcacaccaccagccacgcgactcacccacacctgaggaagaccgacaacgggcacaacaaccgcacccccacgcatccgagcgccgggcaccaccacgcccctcaccaccagccctccaccaccgacacacacacacagcgacgccgacaacatcacccaccccaacaccacgccaacacacccccacaaccccaccgcagacca

SEQ ID NO: 56268 - DNA, 3410 bp, Homo sapiens
  misc_feature (2149)..(2149): n is a, c, g, or t
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggnagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggttcttctctctacaattcgatcttaataaattctttagaatcgtacgtataactc

SEQ ID NO: 56269 - DNA, 2814 bp, Homo sapiens
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaaatacaactttggcttgttaaaaaaaaaaaa

SEQ ID NO: 56270 - DNA, 1768 bp, Homo sapiens
cgaattccgcaccacgccccatcctggggtgcttcaaaccaacggattctggcttacccggggacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaaatacaactttggcttgttaaaaaaaaaaaa

SEQ ID NO: 56271 - DNA, 3663 bp, Homo sapiens
  misc_feature (2149)..(2149): n is a, c, g, or t
tgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcagggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggnagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggaggtggagcgttgatctgacacgcacgaagctcctcaaaggcaccagataactgacagagagcgtgtgaggaggactacccccagtatacatgtgtacactcatctgactgac

SEQ ID NO: 56272 - DNA, 409 bp, Homo sapiens
ggtgtggtacagtatgaagtaaactataaacttgagaactttgtggatttggcttcttggaaagatgcccagtcactgcctctagccgaggttcttcaccattctctttgagaatgacccactacctggaaaaatgcacatgggcatgcctgtacaaaacctttgatgactaagttattttttagtgtatgtcaaatggtatttaacacttcagcctaggcaacagagtgagactccatctccaaaaaaaaacaaaagagagagagagagaaaaatttatcctcgtccaggcacacgtgtcacgcctgtaatcccagcacttcgggaggcaggggcaggagaatcccttcagcccagaagttcgagaccagcctgggcaacgtggtgcattagaaactataccaattta

SEQ ID NO: 56273 - DNA, 233 bp, Homo sapiens
gaactggttacttttaagtaaagagttagacaagaaagaaaatgttccacttagaaagaatgaggtgggtatttttctttgcatcaaaagctacagtaacttcatctataaatcctgagcaagaaatgtccagaataaccacatttcataagctttgctgagtttgagacatctacatagcaacagccttgcgatgggaaaacattaatgctttttatattggtaatcatctg

SEQ ID NO: 56274 - DNA, 217 bp, Homo sapiens
cccgttctcagggatcactgtctttagttgtctgatgcccatattttgaaaaacactatttcatatagtttatccagttcttggttgttttaggtgtggtcttgtcttttagatgttgtcttgtggtcttgttcttgtcttggttgtttcaggtgtgcagaagaatggtaaacctggtctctgttaatctatcttgaccaggagtagaagtccaggt

SEQ ID NO: 56275 - DNA, 369 bp, Homo sapiens
tatttaatcattcttttctttgccctgaagacttaaaactaagaagattattcgaatggtgaattaacttgttgaagaggctattccaaagggatagaatgagactaatttctgactatgttttgctagtgatgggtggatgggaacaaacattacaagaaatagcataatgaatgtagaaaatatttcagtttggagatgtgcatgaattagtttcctaggtttgccacaacaaagcatcccaaactggtggcttaaaaaacagaaatttgtttcatggttcttgagcctagaaggtcaaaatcaaggtgttggcaggaccatgctctctctgaaactctaagggagaagcgttctttgtttcttcct

SEQ ID NO: 56276 - DNA, 900 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56277 - DNA, 951 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56278 - DNA, 980 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacttctcggcgagaaaagaaaaagcttccaggc

SEQ ID NO: 56279 - DNA, 1582 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56280 - DNA, 1708 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56281 - DNA, 1416 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcgagaggtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56282 - DNA, 2047 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcgagaggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56283 - DNA, 2149 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcgagaggtgggcagagcgcccgcagtggcacctccgggcagggggtagcactctgggctctaggcttggcaccccggggcctggcccgatagacaggtgtgtcctcaggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56284 - DNA, 1493 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacttaaaaaaaaattaaaaatacagacaatgctgaagaatgatcttacagcgaagagaacaagtgaagagaagaagcagcacccattcgaatcagccctgcgacgaagccgcgcacatgcatgtaggagatggtgagcgagtcgtctgaggtatgctcggggggcgggaggtgactgagaatgcgtgaagcagttgagcgttgtgtgctggcgtgattggcgcgggatcgca

SEQ ID NO: 56285 - DNA, 2157 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56286 - DNA, 1714 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56287 - DNA, 1309 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacttaaaaaaaaaaattaaaatttaaataaaaaaagtcgtatcgatgt

SEQ ID NO: 56288 - DNA, 1289 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactttcctgcttgggtggctcaaaaaaa

SEQ ID NO: 56289 - DNA, 1473 bp, Homo sapiens
cgtagccggtccaggtctcagatgctgatgtccattccagagcctgtaaagtatgttacatgggatcccagacactgccggcggcgataggatcccctgggaacaagccggagctgtatgaggtgagtggtgggtgcccacccggccggcattggccaacagcaaatgcctgtgtggcctcaccagggtcctgcagcccctgttggcactggcccacagagcccgctctctccggcaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56290 - DNA, 1316 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctggggctagtcggggcccgactagcccgacaggagcccagccagggcaccaccaccttcgctgtgaccagcatactgcgcgtggcagccgaggactggaagaagggggacaccttctcctgcatggtgggccacg

SEQ ID NO: 56291 - DNA, 1119 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56292 - DNA, 1115 bp, Homo sapiens
  misc_feature (969)..(969): n is a, c, g, or t
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggggctganaccctgaggggatgtcggcgcagatagctggagactcacagggcgtagatgcctgtcgactggattaggctacaaagcttaaaccgttcttgatgccgagcccggggactagccctgcccaaggctctgggctgctctggccccgt

SEQ ID NO: 56293 - DNA, 828 bp, Homo sapiens
gtacaagaacgcccgggagagggagaagtacgacaacatggcagactgttgtcgtacgtcatccctctccggagcacgaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56294 - DNA, 1265 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56295 - DNA, 1381 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggtgagtggtgggtgcccacccggccggcattggccaacagcaaatgcctgtgtggcctcaccagggtcctgcagcccctgttggcactggcccacagagcccgctctctccggcaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56296 - DNA, 1369 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56297 - DNA, 2012 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggtgagtggtgggtgcccacccggccggcattggccaacagcaaatgcctgtgtggcctcaccagggtcctgcagcccctgttggcactggcccacagagcccgctctctccggcaggaagtgaagttgtacaagaacgcccgggagagggagaagtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56298 - DNA, 1686 bp, Homo sapiens
atgccgagtcgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgactt

SEQ ID NO: 56299 - DNA, 2077 bp, Homo sapiens
atgccgagtcgctgaccgagcgcaccccgcccccggcgccatcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccaccgcacctggcttaggggccatctttgagtcggccctggctctgctccccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgacttaaaaaaaaacaaaaaaacaaagaaaacacaaagaaaaaaaaaaagaagaaaacaacagacacacaaaaaaaaaacacaggggggggcgcgcgccaaaagaaagtcgctccccgccgggggcgcccccagcagaacgcggcgccccccctatgttttttctgtgggataccaacaatgacgcgcgcgcccccaatataaggagcggccgcgcctccttattatcataacccgaagattacgcagagacgcgcgggcgtatttttttataaccacccagcgtttgtgagatcattagtgtgagtagacacaactgccgggatcgactccctcatgagtgagactccatctatggtgggagggacagaaacaaacaccacctctgtctactaacacgcggtgaggggtggcgagctgtgatcaaacacccatatcttaggcggcgcgcgccacaccaaaacactcaccgcctcacaacacaagaaataaataaattaactagcagcctacctcctactattgaggagaagcagatctaaaacacgtatcatctaataacaactactttcttaggcaccgccgggcgtgacaatattatatgcatgcggtgtgggtaggtcgctacaccaacaacacaaaaccagcagtgtataaacaatcttattagtccgcccgtgtgcgtccagctaagtaacataggagaacagaatgtctctgagtcgaacctccacatcgactgcgatcaagactagatcgatacgttttctctgatcggaggacagcgaacacaattatattttattcgccaccaccgg
